| 
US009974852B2

(12) United States Patent
Heidmann

(10) Patent No.: US 9,974,852 B2
(45) Date of Patent: May 22, 2018

(54) MUTATED NON-PRIMATE LENTIVIRAL ENV PROTEINS AND THEIR USE AS DRUGS

(71) Applicants: VIROXIS S.A.S., Paris (FR); CENTRE NATIONAL DE LA RECHERCHE SCIENTIFIQUE, Paris Cedex 16 (FR); INSTITUT GUSTAVE ROUSSY, Villejuff Cedex (FR); UNIVERSITE PARIS-SUD XI, Orsay Cedex (FR)

(72) Inventor: Thierry Heidmann, Paris (FR)

(73) Assignees: VIROXIS SAS, Paris (FR); CENTRE NATIONAL DE LA RECHERCHE SCIENTIFIQUE, Paris (FR); INSTITUT GUSTAVE ROUSSY, Villejuif (FR); UNIVERSITE PARIS-SUD XI, Orsay (FR)

( * ) Notice: Subject to any disclaimer, the term of this patent is extended or adjusted under 35 U.S.C. 154(b) by 0 days. days.

(21) Appl. No.: 14/896,505

(22) PCT Filed: Jun. 6, 2014

(86) PCT No.: PCT/EP2014/061924
§ 371 (c)(1),
(2) Date: Dec. 7, 2015

(87) PCT Pub. No.: WO2014/195510
PCT Pub. Date: Dec. 11, 2014

(65) Prior Publication Data
US 2016/0129107 A1    May 12, 2016

(30) Foreign Application Priority Data

Jun. 7, 2013  (EP) .................... 13305767

(51) Int. Cl.
*A61K 48/00*    (2006.01)
*A61K 39/00*    (2006.01)
*C12N 15/00*    (2006.01)
*C12N 15/63*    (2006.01)
*A61K 39/21*    (2006.01)
*A61K 39/12*    (2006.01)
*C07K 14/005*    (2006.01)

(52) U.S. Cl.
CPC .............. *A61K 39/21* (2013.01); *A61K 39/12* (2013.01); *C07K 14/005* (2013.01); *A61K 2039/53* (2013.01); *A61K 2039/552* (2013.01); *A61K 2039/572* (2013.01); *C12N 2740/15022* (2013.01); *C12N 2740/15034* (2013.01)

(58) Field of Classification Search
CPC .... A61K 48/00; A61K 2300/00; C12N 15/86; C12N 2740/15043; C07K 14/005
See application file for complete search history.

(56) References Cited

FOREIGN PATENT DOCUMENTS

WO    2005/095442 A1    10/2005
WO    2010/022740 A2    3/2010

OTHER PUBLICATIONS

Denner J et al.: "The Immunosuppressive Peptide of HIV-1: Functional Domains and Immune Response in AIDS Patients" AIDS, Philadelphia,PA, us, vol. 8, No. 8, Aug. 1, 1994 (Aug. 1, 1994), pp. 1063-1072, XP000647542, the whole document.
Mangeney M et al.: "Placental syncytins: Genetic disjunction between the fusogenic and immunosuppressive activity of retroviral envelope proteins", Proceedings of the National Academy of Sciences, National Academy of Sciences, us, vol. 104, No. 51, Dec. 18, 2007 (Dec. 18, 2007), pp. 20534-20539, XP002633415, ISSN: 0027-8424, DOI: 10.1073/PNAS.0707873105 [retrieved on Dec. 12, 2007] the whole document.
Geraldine Schlecht-Louf et al.: "Retroviral infection in vivo requires an immune escape virulence factor encrypted in the envelope protein of oncoretroviruses", Proceedings of the National Academy of Sciences, National Academy of Sciences, us, vol. 107, No. 8, Feb. 23, 2010 (Feb. 23, 2010), pp. 3782-3787, XP002675453, ISSN: 0027-8424, DOI: 10.1073/PNAS.0913122107 [retrieved on Feb. 8, 2010] the whole document.
EP Search Report, dated Aug. 13, 2013, from corresponding EP application.
International Search Report, dated Aug. 8, 2014, from corresponding PCT application.

*Primary Examiner* — Janet L Andres
*Assistant Examiner* — Barry A Chestnut
(74) *Attorney, Agent, or Firm* — Young & Thompson

(57) ABSTRACT

A pharmaceutical composition includes, as active substance a mutated non-primate lentiviral Env protein having decreased immunosuppressive properties, substantially no immunosuppressive properties or no immunosuppressive properties, or a variant of the mutated lentiviral Env protein, or a fragment of the above proteins, in association with a pharmaceutically acceptable carrier.

23 Claims, 8 Drawing Sheets

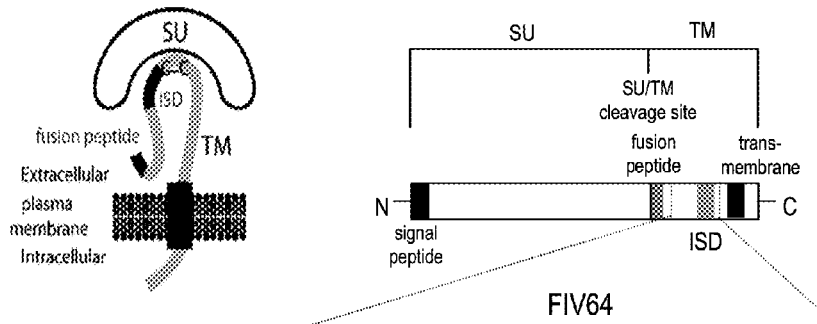

Figure 1A:
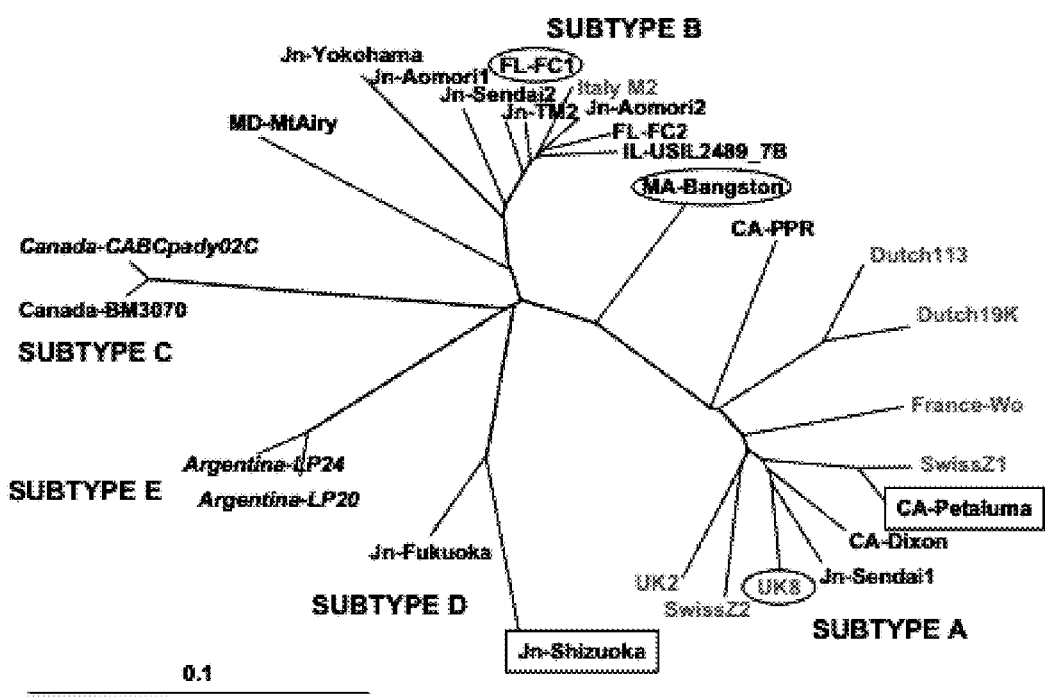

| | | |
|---|---|---|
| CAA40315.1 | QVLATHQEAIEKVTEALKINNLRLVTLEHQVLVIGLKVEAMEKFLYTAFAMQELGCNQNQFFCKVPPVLWER | (SEQ ID NO : 469) |
| 1805419B | QVLATHQEAIEKVTEALKINNLRLVTLEHQVLVIGLKVEAMEKFLYTAFAMQELGCNQNQFFCKVPPVLWER | (SEQ ID NO : 469) |
| NP_040976.1 | QVLATHQEAVEKVTEALKINNLRLVTLEHQVLVIGLKVEAMEKFLYTAFAMQELGCNQNQFFCKIPPELWTR | (SEQ ID NO : 470) |
| AAB59940.1 | QVLATHQEAVEKVTEALKINNLRLVTLEHQVLVIGLKVEAMEKFLYTAFAMQELGCNQNQFFCKIPPELWTR | (SEQ ID NO : 470) |
| ACX55587.1 | QVLATHQEAIEKVTEALKINNLRLVTLEHQVLVIGLKVEAMEKFLYTAFAMQELGCNQNQFFCKIPPGLWTR | (SEQ ID NO : 471) |
| 1805419A | QVLATHQEAIEKVTEALKINNLRLVTLEHQVLVIGLKVEAMEKFLYTAFAMQELGCNQNQFFCKIPPGLWTR | (SEQ ID NO : 471) |
| CAA40321.1 | QVLATHQEAIEKVTEALKINNLRLVTLEHQVLVIGLKVEAMEKFLYTAFAMQELGCNQNQFFCKIPPGLWTR | (SEQ ID NO : 471) |
| ENV_FIVPE | QVLATHQEAIEKVTGALKINNLRLVTLEHQVLVIGLKVEAMEKFLYTAFAMQELGCNQNQFFCKIPLELWTR | (SEQ ID NO : 472) |
| AAB25466.1 | QVLATQQEAIEKVTEALKITNLRLVTLEHQVLVIGLKVEAMEKFLYTAFAMQELGCNQNQFFCKVPPELWRR | (SEQ ID NO : 473) |
| ENV_FIVU1 | QVLATQQEAIEKVTEALKITNLRLVTLEHQVLVIGLKVEAMEKFLYTAFAMQELGCNQNQFFCKVPPELWRR | (SEQ ID NO : 473) |
| CAA43131.1 | QVLATQQEAIEKVTEALKITNLRLVTLEHQVLVIGLKVEAMEKFLYTAFAMQELGCNQNQFFCKVPPELWRR | (SEQ ID NO : 473) |
| AF474246_5 | QVLATHQEALDKITEALKINNLRLVTLEHQVLVIGLKVEATEKFLYTAFAMQELGCNQNQFFCKIPCELWMR | (SEQ ID NO : 474) |
| AAB09312.1 | QVLATHQQALDKITEALKINNLRLITLEHQVLVIGLKVEAIEKFLYTAFAMQELGCNQNQFFCKIPPSLWSM | (SEQ ID NO : 475) |
| AAA43074.1 | QVLATHQQALEKITEALKINNLRLITLEHQVLVIGLRVEAIEKFLYTAFAMQELGCNQNQFFCKIPPSLWSM | (SEQ ID NO : 476) |
| ENV_FIVT2 | QVLATHQQALEKITEALKINNLRLITLEHQVLVIGLRVEAIEKFLYTAFAMQELGCNQNQFFCKIPPSLWSM | (SEQ ID NO : 476) |
| BAA07063.1 | QVLATHQQALDKITEALKINNLRLITLEHQVLVIGLKVEAIEKFLYTAFAMQELGCHQNQFFCKIPPSLWSM | (SEQ ID NO : 477) |
| BAA07062.1 | QVLATHQQALDKITEALKINNLRLITLEHQVLVIGLKVEAIEKFLYTAFAMQELGCNQNQFFCKIPPSLWSM | (SEQ ID NO : 475) |
| BAA07060.1 | QVLATHQQALDKITEALKINNLRLITLEHQVLVIGLKVEAIEKFLYTAFAMQELGCNQNQFFCKIPPSLWSM | (SEQ ID NO : 475) |
| BAA07058.1 | QVLATHQQALDKITEALKINNLRLITLVHQVLVIGLKVEAIEKFLYTAFAMQELGCNQNQFFCKIPPSLWSM | (SEQ ID NO : 478) |
| AAT44733.1 | QVLATHQQALDKITQALKINNLRLITLEHQVLVIGLKVEAIEKFLYTAFAMQELGCNQNQFFCKIPPSLWSM | (SEQ ID NO : 479) |
| AAT41620.1 | QVLATHQQALDKITEALKINNLRLITLEHQVLVIGLKVEAIEKFLYTAFAMQELGCNQNQFFCKIPLNLWNM | (SEQ ID NO : 480) |
| AF452127_1 | QVLATHQQALEKITEALKINNLRLVTLEHQVLMIGLKVEAIEKFLYTAFAMQELGCNQNQFFCKIPLNLWTM | (SEQ ID NO : 481) |
| AF452126_1 | QVLATHQQALEKITEALKINNLRLVTLEHQVLMIGLKVEAIEKFLYTAFAMQELGCNQNQFFCKIPLNLWTM | (SEQ ID NO : 481) |
| BAA07061.1 | QVLATHQQALDKITEALKINNLRLITLEHQVLVIGLKVEAIEKFLYTAFAMQELGCNQNQFFCKIPPSLWSM | (SEQ ID NO : 475) |
| BAA07057.1 | QVLATHQKAIDQITEALKINNLRLVTLEHQVLVIGLKVEAIEKFIYTAFAMQELGCNQNQFFCKIPPELWIR | (SEQ ID NO : 482) |
| ENV_FIVSD | QVLATHQEALDKITEALKINNLRLVTLEHQMLVIGLKVEAIEKFLYTAFAMQELGCNQNQFFCEIPKELWLR | (SEQ ID NO : 483) |
| AAA43068.1 | QVLATHQEAIEKVTEALKINNLRLVTLEHQVLVIGLKVEAMEKFLYTAFAMQELGCNQNQFFCKVPSALWER | (SEQ ID NO : 484) |
| ENV_FIVWO | QVLATHQEAIEKVTEALKINNLRLVTLEHQVLVIGLKVEAMEKFLYTAFAMQELGCNQNQFFCKVPSALWER | (SEQ ID NO : 484) |
| AAK83091.1 | QVLATHQEAIEKVTEALKINNLRLVTLEHQVLVIGLKVEAMEKFLYTAFAMQELGCNQNQFFCKVPSALWER | (SEQ ID NO : 484) |
| AAA72278.1 | QVLATHQEAIEKVTEALKINNLRLVTLEHQVLVIGLKVEAMEKFLYTAFAMQELGCNQNQFFCKVPPQLWKR | (SEQ ID NO : 485) |
| ENV_FIVU8 | QVLATHQETIEKVTEALKINNLRLVTLEHQVLVIGLKVEAMEKFLYTAFAMQELGCNQNQFFCKVPPELWKR | (SEQ ID NO : 486) |
| BAA07059.1 | QVLATHQEAIEKVTEALKVNNLRLITLEHQVLVIGLKVEAMEKFLYTAFAMQELGCNQNQFFCKVPPELWKR | (SEQ ID NO : 487) |
| ENV_FIVU2 | QVLATHQETIEKITEALKVNNLRLVTLEHQVLVIGLKVEAIEKFLYTAFAMQELGCNQNQFFCKVPPELWQR | (SEQ ID NO : 488) |

Figure 1B

Figure 2

MUTATED NON-PRIMATE LENTIVIRAL ENV PROTEINS AND THEIR USE AS DRUGS

The present invention relates to mutated non-primate lentiviral ENV proteins and their use as drugs.

Lentivirus is a genus of slow viruses of the Retroviridae family, characterized by a long incubation period. Lentiviruses have the unique ability among retroviruses of being able to integrate into the DNA of the host and replicate in non-dividing cells. They are in most cases pathogenic, infection resulting in a severe immunodeficiency syndrome (AIDS).

Lentiviruses can be found in primates including humans (HIV1, HIV2) and monkeys (SIV), as well as in other animals.

As examples of animal lentiviruses, one may cite feline lentiviruses such as Feline Immunodeficiency Virus (FIV) which can be found in cats, as well as in other felidae (e.g. lion, cougar).

Other examples of animal lentiviruses are bovine immunodeficiency virus (BIV), Jembrana disease virus (JDV, BIV from Indonesia), equine infectious anaemia virus (EIAV), caprine arthritis encephalitis virus (CAEV), Visna/Maedi virus (VMV) and ovine Visna/Maedi virus (OMVV).

Feline immunodeficiency virus (FIV) causes an AIDS-like syndrome in the domestic cat, with marked similarity to AIDS caused by human immunodeficiency virus (HIV) in humans. FIV in cats typically manifests itself as a transient acute-phase syndrome, characterized by febrile episodes, lymphadenopathy, neutropenia, and weight loss. This initial phase is followed by a protracted asymptomatic period with progressive loss of CD4+ T lymphocytes and a terminal AIDS phase characterized by succumbing to opportunistic infections. Variability exists among FIV strains, not only in sequence relatedness but also in pathogenicity in vivo. FIV has been reported worldwide with a prevalence rate ranging from 1 to 28%. It affects 2-4% of cats in the US.

Following criteria similar to those for HIV subgroups distinction, FIV has been classified into subgroups according to the envelop protein (Env) diversity. Sodora et al. defined the original Petaluma strain as a prototype subgroup A and the divergent Japanese TM2 strain as prototype subgroup B. A majority of FIV sequences obtained worldwide were categorized in the A and B subgroups. A subtype C was also defined and is the least prevalent FIV subgroup, as well as two other subtypes D and E.

As in the case of HIV, the development of an effective vaccine against FIV is difficult because of the variations of the virus strains, most probably associated with the high intrinsic mutation rate of its replicative machinery. A dual-subtype vaccine for FIV released in 2002 called Fel-O-Vax was shown to have some protective effect against subtypes A and B FIV, but a more effective vaccine is still needed for an efficient protection of cats.

A key feature that could result in higher efficacy of a FIV dedicated vaccine is to increase the immunogenicity of the FIV antigens that are introduced in the vaccine. In this respect, it is essential to ascertain that the antigens do not carry an immunosuppressive activity, which would severely decrease the immunogenicity of the vaccine. In fact, most vaccines against retroviruses contain the Env protein as it is the first exposed viral protein to be «seen» by the immune system of an infected animal, and it is important for a vaccinated animal to be able to mount an efficient line of defense against this protein. Yet, it has been shown in the case of the non-lentiviral retroviruses—including oncoretroviruses such as the feline FeLV or the human HTLV retroviruses—that their Env protein carries an immunosuppressive activity which drastically decreases the immunogenicity of the corresponding proteins, and severely impairs the efficacy of a vaccine expressing the Env protein.

Consequently for a vaccine, there is a need to provide proteins as antigens having lost, or substantially lost, their immunosuppressive functions, in order to generate an efficient response. This will enable the animals once infected by the virus to allow the immune system to destroy the infected cells and prevent/cure the infection.

One aim of the invention is to provide new mutated Env proteins devoid of immunosuppressive properties.

Another aim of the invention is to provide new mutated animal Env proteins.

Another aim of the invention is to provide a new pharmaceutical composition efficient for preventing/treating lentiviral infection.

Another aim of the invention is to provide an efficient vaccine against animal lentiviruses, in particular feline lentiviruses.

The invention relates to a pharmaceutical composition comprising as active substance an isolated mutated feline lentiviral ENV protein having a decreased immunosuppressive activity, substantially no immunosuppressive activity or no immunosuppressive activity, or a fragment thereof, said mutated feline lentiviral ENV protein resulting from mutation of the transmembrane (TM) subunit of a wild type feline lentiviral ENV protein, said mutated ENV protein having at least 70% identity, preferably at least 80% identity, to the sequence SEQ ID NO: 5, said mutated feline lentiviral ENV protein or fragment thereof comprising a mutated immunosuppressive domain (ISU) containing the following amino acid sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein, $X_1$ is any amino acid different from E or deleted, and/or $X_2$ is any amino acid different from K or deleted, and/or $X_3$ is any amino acid different from F or deleted, and/or $X_4$ is any amino acid different from L or deleted, and/or $X_5$ is any amino acid different from Y or deleted, in association with a pharmaceutically acceptable carrier.

In particular, the invention relates to a pharmaceutical composition comprising as active substance an isolated mutated feline lentiviral ENV protein having a decreased immunosuppressive activity, substantially no immunosuppressive activity or no immunosuppressive activity, or a fragment thereof, in particular said fragment of said isolated mutated feline lentiviral ENV protein comprising at least 40 amino acids, in particular at least 60 amino acids, said mutated feline lentiviral ENV protein resulting from mutation of the transmembrane (TM) subunit of a wild type feline lentiviral ENV protein, said mutated ENV protein having at least 70% identity, preferably at least 80% identity, to the sequence SEQ ID NO: 5, said mutated feline lentiviral ENV protein or fragment thereof comprising a mutated immunosuppressive domain (ISU) containing the following amino acid sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein, $X_1$ is A, F, G, L or R, and $X_2$, $X_3$, $X_4$ and $X_5$ are any amino acid, or $X_2$ is A, F, G, L or R, and $X_1$, $X_3$, $X_4$ and $X_5$ are any amino acid, or $X_3$ is A, G, L or R, and $X_1$, $X_2$, $X_4$ and $X_5$ are any amino acid, or $X_4$ is A, F, G or R, and $X_1$, $X_2$, $X_3$ and $X_5$ are any amino acid, or $X_5$ is A, F, G, L or R, and $X_1$, $X_2$, $X_3$ and $X_4$ are any amino acid, in association with a pharmaceutically acceptable carrier.

The present application is based on the unexpected observation made by the Inventors that some specific amino acids of the immunosuppressive domain (ISU) of a lentiviral Env protein can be mutated conferring to said lentiviral Env protein decreased immunosuppressive properties, substantially no immunosuppressive properties or no immunosuppressive properties, while retaining its antigenicity, the three-dimensional structure of the immunosuppressive domain, and its expression at the plasma membrane.

The expression "having decreased immunosuppressive properties" means that the mutated Env protein has lost at least 50% of its immunosuppressive activity in comparison to the immunosuppressive activity of the wild type Env protein.

The expression "having substantially no immunosuppressive properties" means that the mutated Env protein has lost at least 75% of its immunosuppressive activity in comparison to the immunosuppressive activity of the wild type Env protein.

The expression "having no immunosuppressive properties" means that the mutated Env protein has lost 100% of its immunosuppressive activity in comparison to the immunosuppressive activity of the wild type Env protein.

Moreover, the mutated lentiviral Env protein according to the invention has retained a part or the totality of its fusogenic activity.

In the invention, the expression "mutated feline lentiviral ENV proteins" means that the ENV proteins derive from the expression of an env gene of a lentivirus of a feline.

Feline lentiviruses according to the invention encompass the FIV which can be found in cats, as well as in other felidae (e.g. lion, cougar).

Because of the natural variability of feline lentiviruses, the "mutated Env protein", as defined in the invention, encompasses two meanings.

According to the first meaning, the said "mutated ENV protein" is the unnatural result of the intervention of human beings.

According to the second meaning, the mutated Env protein also encompasses naturally occurring variants for which up to now the non immunosuppressive properties remain unknown.

This second meaning takes into consideration the natural variability of FIV variants inside a same infected animal, wherein the said "mutated Env protein" might be non immunosuppressive but its property is undetectable because an FIV infected animal carries many FIV variants, the majority of which is immunosuppressive.

The following protein (Accession No. P16090) corresponds to the wild type sequence of the Env protein of FIV (Petaluma strain). In the invention, it is considered as a reference sequence of the wild type ENV protein.

wild type FIV Env
(Petaluma strain)

SEQ ID NO: 4

MAEGFAANRQWIGPEEAEELLDFDIATQMSEEGPLNPGVNPFRVPGI

TEKEKQNYCNILQPKLQDLRNEIQEVKLEEGNAGKFRRARFLRYSDE

RVLSLVHAFIGYCIYLGNRNKLGSLRHDIDIEAPQEECYNNREKGTT

DNIKYGRRCCLGTVTLYLILFTGVIVYSQTAGAQVVWRLPPLVVPVE

ESEIIFWDCWAPEEPACQDFLGAMIHLKAKTNISIREGPTLGNWARE

IWATLFKKATRQCRRGRIWKRWNETITGPSGCANNTCYNVSVIVPDY

QCYLDRVDTWLQGKINISLCLTGGKMLYNKVTKQLSYCTDPLQIPLI

NYTFGPNQTCMWNTSQIQDPEIPKCGWWNQMAYYNSCKWEEAKVKFH

CQRTQSQPGSWFRAISSWKQRNRWEWRPDFKSKKVKISLPCNSTKNL

TFAMRSSGDYGEVTGAWIEFGCHRNKSNLHTEARFRIRCRWNVGSDT

SLIDTCGNTPNVSGANPVDCTMYSNKMYNCSLQNGFTMKVDDLIVHF

NMTKAVEMYNIAGNWSCTSDLPSSWGYMNCNCTNSSSSYSGTKMACP

SNRGILRNWYNPVAGLRQSLEQYQVVKQPDYLLVPEEVMEYKPRRKR

AAIHVMLALATVLSIAGAGTGATAIGMVTQYHQVLATHQEAIEKVTG

ALKINNLRLVTLEHQVLVIGLKVEAMEKFLYTAFAMQELGCNQNQFF

CKIPLELWTRYNMTINQTIWNHGNITLGEWYNQTKDLQQKFYEIIMD

IEQNNVQGKTGIQQLQKWEDWVRWIGNIPQYLKGLLGGILGIGLGVL

LLILCLPTLVDCIRNCIHKILGYTVIAMPEVEGEEIQPQMELRRNGR

QCGMSEKEEE

Variants of the FIV mutated Env proteins according to the invention have at least 70%, preferably at least 80%, more preferably at least 90% of identity with the wild type amino acid sequence of the FIV Env protein, and comprise the mutations as described above, and harbour a decreased immunosuppressive activity, substantially no immunosuppressive activity or no immunosuppressive activity.

A region of the feline lentiviral Env protein containing the amino acids which may be mutated according to the invention can be delimited by the sequence SEQ ID NO: 2:

$$\text{G-L-[K/T/R]-[V/I]-[E/R]-A-[I/M/T/L]-E-K-[F/P]-} \quad \text{(SEQ ID NO: 2)}$$
$$\text{[L/V/I]-Y-T-A-[F/L]-A-M.}$$

SEQ ID NO: 2 corresponds to the consensus sequence of a specific region of the ISU domain. In the invention, the ISU domain comprises SEQ ID NO: 2.

When applying the mutations as defined above, the ISU domain of the Env protein loses partially or totally its immunosuppressive properties.

Examples of fragments of the wild type ISU domains of FIV:

| Examples of fragments of the wild type ISU domains of FIV: |
| --- |
| (SEQ ID NO: 6)<br>AIEKVTGALKINNLRLVTLEHQVLVIGLKVEAMEKFLYTAFAMQELGCNQ<br>NQFFCKIPLELWTR |
| (SEQ ID NO: 7)<br>AVEKVTEALKINNLRLVTLEHQVLVIGLKVEAMEKFLYTAFAMQELGCNQ<br>NQFFCKIPPELWTR |
| (SEQ ID NO: 8)<br>AIEKVTEALKITNLRLVTLEHQVLVIGLKVEAMEKFLYTAFAMQELGCNQ<br>NQFFCKVPPELWRR |
| (SEQ ID NO: 9)<br>AIEKVTEALKINNLRLVTLEHQVLVIGLKVEAIEKFLYTAFAMQELGCNQ<br>NQFFCKVPLELWRR |
| (SEQ ID NO: 10)<br>AIEKVTEALKINNLRLVTLEHQVLVIGLKVEAMEKFLYTAFAMQELGCNQ<br>NQFFCKVPSALWER |
| (SEQ ID NO: 11)<br>AIEKVTEALKINNLRLVTLEHQVLVIGLKVEAMEKFLYTAFAMQELGCNQ<br>NQFFCKIPPGLWTR |
| (SEQ ID NO: 12)<br>AIEKVTEALKINNLRLVTLEHQVLVIGLKVEAMEKFLYTAFAMQELGCNQ<br>NQFFCKVPPQLWKR |
| (SEQ ID NO: 13)<br>AIEKVTEALKVNNLRLITLEHQVLVIGLKVEAMEKFLYTAFAMQELGCNQ<br>NQFFCKVPPELWKR |
| (SEQ ID NO: 14)<br>TIEKVTEALKINNLRLVTLEHQVLVIGLKVEAMEKFLYTAFAMQELGCNQ<br>NQFFCKVPPELWKR |
| (SEQ ID NO: 15)<br>AIEKVTEALKINNLRLVTLEHQVLVIGLKVEAMEKFLYTAFAMQELGCNQ<br>NQFFCKVPPVLWER |
| (SEQ ID NO: 16)<br>TIEKITEALKVNNLRLVTLEHQVLVIGLKVEAIEKFLYTAFAMQELGCNQ<br>NQFFCKVPPELWQR |
| (SEQ ID NO: 17)<br>AIDQITEALKINNLRLVTLEHQVLVIGLKVEAIEKFIYTAFAMQELGCNQ<br>NQFFCKIPPELWIR |
| (SEQ ID NO: 18)<br>ALDKITEALKINNLRLITLEHQVLVIGLKVEAIEKFLYTAFAMQELGCNQ<br>NQFFCKIPPSLWSM |
| (SEQ ID NO: 19)<br>ALDKITEALKINNLRLVTLEHQVLVIGLKVEATEKFLYTAFAMQELGCNQ<br>NQFFCKIPCELWMR |
| (SEQ ID NO: 20)<br>ALEKITEALKINNLRLVTLEHQVLMIGLKVEAIEKFLYTAFAMQELGCNQ<br>NQFFCKIPLNLWTM |
| (SEQ ID NO: 21)<br>ALDKITEALKINNLRLITLVHQVLVIGLKVRAIEKPLYTAFAMQELGCNQ<br>NQFFCKIPPSLWSM |
| (SEQ ID NO: 22)<br>ALEKITEALKINNLRLITLEHQVLVIGLRVEAIEKFLYTAFAMQELGCNQ<br>NQFFCKIPPSLWSM |
| (SEQ ID NO: 23)<br>ALEKITEALKINNLRLITLEHQVLVIGLKVEAIEKFLYTAFAMQELGCHQ<br>NQFFCKIPPSLWSM |
| (SEQ ID NO: 24)<br>ALDKITEALKINNLRLITLEHQVLVIGLKVEAIEKFLYTAFAMQELGCNQ<br>NQFFCKIPPSLWSM |
| (SEQ ID NO: 25)<br>ALDKITQALKINNLRLITLEHQVLVIGLKVEAIEKFLYTAFAMQELGCNQ<br>NQFFCKIPPSLWSM |
| (SEQ ID NO: 26)<br>ALDKITEALKINNLRLITLEHQVLVIGLKVEAIEKFLYTAFAMQELGCNQ<br>NQFFCKIPLNLWNM |
| (SEQ ID NO: 27)<br>ALDKITEALKINNLRLVTLEHQMLVIGLKVEAIEKFLYTAFAMQELGCNQ<br>NQFFCEIPKELWLR |

The localization of an ISU domain can be determined in all Env proteins of viruses as described in Benit et al. 2001, *Journal of Virology*, Vol. 75, No. 23, p. 11709-11719. In a broad meaning, the ISU domain is defined by its structure and its localization, irrespective of the fact that it possesses or not an immunosuppressive activity.

In the invention, the ISU domain refers to a specific domain in which a mutation can affect the immunosuppressive property of the ENV protein.

As an example of a mutated feline lentiviral Env protein, SEQ ID NO: 5 corresponds to the sequence of a mutated Env protein of the FIV Petaluma strain. In the invention, it is considered as a reference sequence of the mutated Env protein.

More specifically, SEQ ID NO: 5 corresponds to the SEQ ID NO: 4 in which the amino acid residue F in position 5 ($X_3$) of the sequence A-[I/M/T/L]-$X_1$-$X_2$-$X_3$-$X_4$-$X_5$-T-A (SEQ ID NO: 1) has been substituted by R.

mutated FIV Env
SEQ ID NO: 5
MAEGFAANRQWIGPEEAEELLDFDIATQMSEEGPLNPGVNPFRV

PGITEKEKQNYCNILQPKLQDLRNEIQEVKLEEGNAGKFRRARF

LRYSDERVLSLVHAFIGYCIYLGNRNKLGSLRHDIDIEAPQEEC

YNNREKGTTDNIKYGRRCCLGTVTLYLILFTGVIVYSQTAGAQV

VWRLPPLVVPVEESEIIFWDCWAPEEPACQDFLGAMIHLKAKTN

ISIREGPTLGNWAREIWATLFKKATRQCRRGRIWKRWNETITGP

SGCANNTCYNVSVIVPDYQCYLDRVDTWLQGKINISLCLTGGKM

-continued

```
LYNKVTKQLSYCTDPLQIPLINYTFGPNQTCMWNTSQIQDPEIP

KCGWWNQMAYYNSCKWEEAKVKFHCQRTQSQPGSWFRAISSWKQ

RNRWEWRPDFKSKKVKISLPCNSTKNLTFAMRSSGDYGEVTGAW

IEFGCHRNKSNLHTEARFRIRCRWNVGSDTSLIDTCGNTPNVSG

ANPVDCTMYSNKMYNCSLQNGFTMKVDDLIVHFNMTKAVEMYNI

AGNWSCTSDLPSSWGYMNCNCTNSSSSYSGTKMACPSNRGILRN

WYNPVAGLRQSLEQYQVVKQPDYLLVPEEVMEYKPRRKRAAIHV

MLALATVLSIAGAGTGATAIGMVTQYHQVLATHQEAIEKVTGAL

KINNLRLVTLEHQVLVIGLKVEAMEKRLYTAFAMQELGCNQNQF

FCKIPLELWTRYNMTINQTIWNHGNITLGEWYNQTKDLQQKFYE

IIMDIEQNNVQGKTGIQQLQKWEDWVRWIGNIPQYLKGLLGGIL

GIGLGVLLLILCLPTLVDCIRNCIHKILGYTVIAMPEVEGEEIQ

PQMELRRNGRQCGMSEKEEE
```

The invention also encompasses the variants of the "mutated feline lentiviral Env protein", harbouring the above mentioned mutations, and conferring a decrease or a lack of immunosuppressive properties to said variant.

Variants of the FIV mutated Env proteins according to the invention have at least 70%, preferably at least 80%, more preferably at least 90% of identity with the reference mutated sequence of FIV env protein (SEQ ID NO: 5), and comprise the mutations as described above, and harbour a decreased immunosuppressive activity, substantially no immunosuppressive activity or no immunosuppressive activity.

Variants of the FIV mutated Env proteins according to the invention have at least 90% of identity with the transmembrane region of SEQ ID NO 5

According to a particular embodiment of the invention, variants of the FIV mutated Env proteins according to the invention have a transmembrane region which has at least 90% of identity with the transmembrane region of the FIV mutated Env protein, said variants comprising a mutated immunosuppressive domain (ISU) containing the sequence SEQ ID NO: 1.

According to another particular embodiment of the invention, variants of the FIV mutated Env proteins according to the invention have a 64 amino acid sequence, corresponding to a fragment of the ISU domain, which has at least 95% of identity with a 64 amino acid sequence of the FIV mutated Env protein comprising the sequence SEQ ID NO: 1.

In a particular embodiment, the invention relates to a pharmaceutical composition as defined above comprising as active substance an isolated mutated feline lentiviral ENV protein having a decreased immunosuppressive activity, substantially no immunosuppressive activity or no immunosuppressive activity, or a fragment thereof, said mutated feline lentiviral ENV protein resulting from mutation of the transmembrane (TM) subunit of a wild type feline lentiviral ENV protein, said mutated ENV protein having at least 70% identity, preferably at least 80% identity, to the sequence SEQ ID NO: 5, said mutated feline lentiviral ENV protein or fragment thereof comprising a mutated immunosuppressive domain (ISU) containing the following amino acid sequence:

$$\text{(SEQ ID NO: 3)}$$
$$[V/I]-[E/R]-A-[I/M/T/L]-X_1-X_2-X_3-X_4-X_5-T-A-[F/L]-A-M,$$

wherein,
$X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted,
in particular, wherein,
$X_1$ is A, F, G, L or R, and $X_2$, $X_3$, $X_4$ and $X_5$ are any amino acid, or
$X_2$ is A, F, G, L or R, and $X_1$, $X_3$, $X_4$ and $X_5$ are any amino acid, or
$X_3$ is A, G, L or R, and $X_1$, $X_2$, $X_4$ and $X_5$ are any amino acid, or
$X_4$ is A, F, G or R, and $X_1$, $X_2$, $X_3$ and $X_5$ are any amino acid, or
$X_5$ is A, F, G, L or R, and $X_1$, $X_2$, $X_3$ and $X_4$ are any amino acid,
in association with a pharmaceutically acceptable carrier.

SEQ ID NO: 3 (14 amino acid long) is a consensus sequence containing SEQ ID NO: 1 (9 amino acid long).

The invention relates to a pharmaceutical composition as defined above comprising as active substance an isolated mutated feline lentiviral ENV protein having a decreased immunosuppressive activity, substantially no immunosuppressive activity or no immunosuppressive activity, or a fragment thereof, said mutated feline lentiviral ENV protein resulting from mutation of the transmembrane (TM) subunit of a wild type feline lentiviral ENV protein, said mutated ENV protein having at least 70% identity, preferably at least 80% identity, to the sequence SEQ ID NO: 5, said mutated feline lentiviral ENV protein or fragment thereof comprising a mutated immunosuppressive domain (ISU) containing the following amino acid sequence:

$$\text{(SEQ ID NO: 1)}$$
$$A-[I/M/T/L]-X_1-X_2-X_3-X_4-X_5-T-A,$$

wherein,
$X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted,
in particular, wherein,
$X_1$ is A, F, G, L or R, and $X_2$, $X_3$, $X_4$ and $X_5$ are any amino acid, or
$X_2$ is A, F, G, L or R, and $X_1$, $X_3$, $X_4$ and $X_5$ are any amino acid, or
$X_3$ is A, G, L or R, and $X_1$, $X_2$, $X_4$ and $X_5$ are any amino acid, or
$X_4$ is A, F, G or R, and $X_1$, $X_2$, $X_3$ and $X_5$ are any amino acid, or
$X_5$ is A, F, G, L or R, and $X_1$, $X_2$, $X_3$ and $X_5$ are any amino acid,
in association with a pharmaceutically acceptable carrier, said decrease, substantial absence or absence of immunosuppressive activity of the above mentioned mutated feline lentiviral ENV protein or of the above defined fragment being liable to be assessed by the fact that in an in vivo assay involving engrafted tumor cells rejection, in animals excluding human beings, said tumor cells being transduced either so as to express said mutated ENV protein or said fragment (mutated ENV tumor cells), or said tumor cells being transduced so as to express said wild type ENV protein or a fragment thereof (wild type ENV tumor cells), or said tumor cells being not transduced (normal tumor cells), the following ratio:

immunosuppression index of said mutated ENV protein or of said fragment ($i_{mutated\ env}$)/immunosuppression index of wild type ENV protein ($i_{wild\ type\ env}$) is less than 0.5, or even less than 0.25, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

The immunosuppressive property of the ENV protein is preferably measured using in vivo procedures, which are representative of the physiological environment.

The immunosuppressive property of the mutated ENV proteins according to the invention is measured according to an in vivo procedure to assay the immunosuppressive activity of a ENV protein disclosed previously [Mangeney and Heidmann Proc Natl Acad Sci USA 1998; 95: 14920-14925; Mangeney et al. Proc Natl Acad Sci USA, 2007, 104(51): 20534-9].

As a physiological test, this in vivo procedure is performed using ENV proteins, or fragment thereof, which are not associated to another component or carrier proteins, such as BSA.

Figure 3:
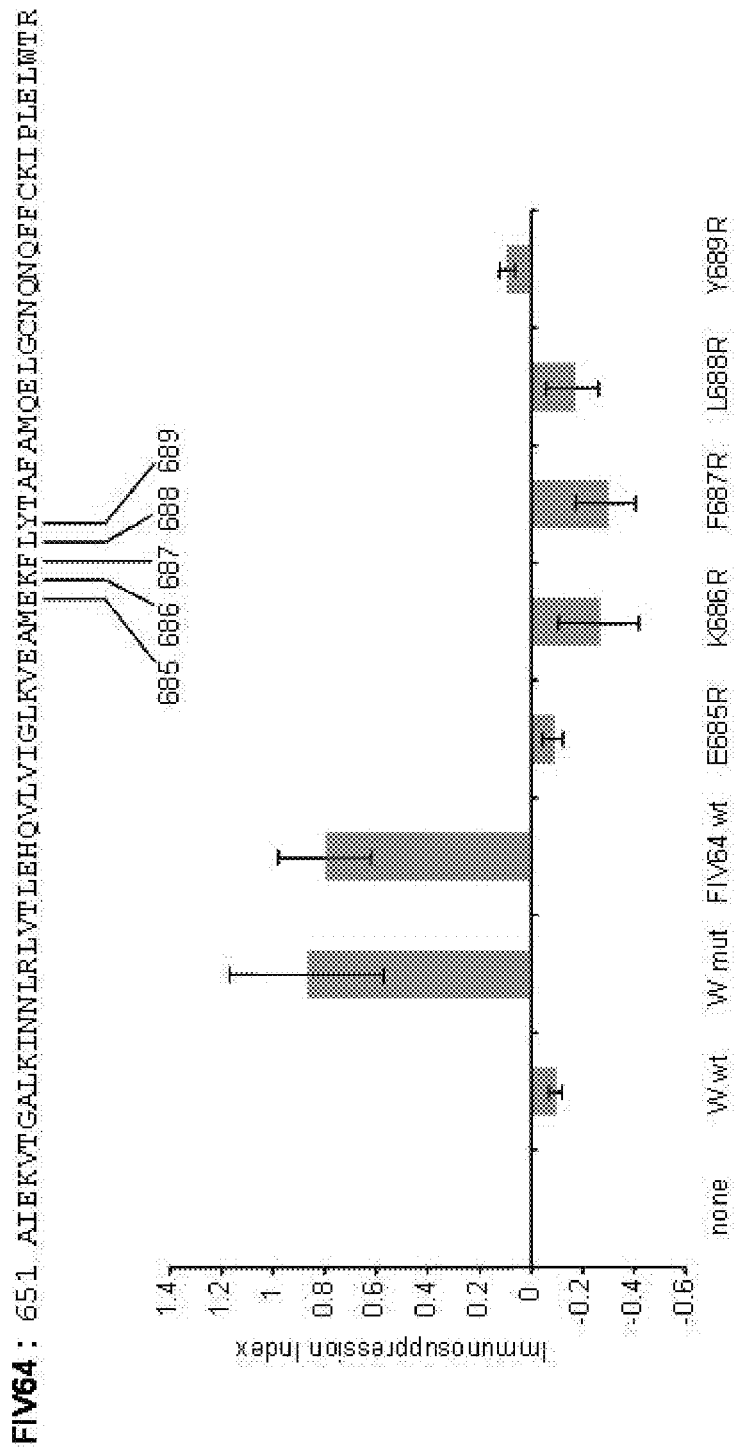

Briefly, a wild-type (wild type lentiviral ENV protein) or modified nucleic acid expressing the protein to be tested (mutated lentiviral ENV protein) is transduced in tumour cell lines such as MCA 205 or C18.1 cell lines by known transduction methods. The tumour cells expressing the protein to be tested are then injected especially subcutaneous (s.c.) injection to a host, generally mice. Following said injection, the establishment of tumour or, to the contrary, its rejection, is determined and the tumour area is measured. Tumour establishment is determined by palpation and tumour area (mm²) is determined by measuring perpendicular tumour diameters. Immunosuppression index is defined as $i=(S_{env}-S_{none})/S_{none}$, wherein $S_{env}$ is the maximum area reached by a tumour expressing an envelope protein and $S_{none}$ is the maximum area reached by a tumour not expressing ENV protein (negative control). According to an embodiment of the invention, the above defined ratio relative to the immunosuppression index ($i_{mutated\ env}/i_{wild\ type\ env}$) can be less than 0.25, and can even have a negative value (see FIG. 3).

In vitro assay could be carried out, using high doses of synthetic peptides but they are indirect and less convincing, since the expression "immunosuppressive" is relevant when applied to animals possessing a complete immune system and not to cell lines. An additional difficulty for the functional characterization of an ISU domain relies on the fact that the ISU carried by the retroviral Env proteins is a highly structured proteic domain, with trimer formation within the complete Env proteins (Caffrey M., Biochimica et Biophysica Acta, 1536:116-122, 2001; Caffrey et al., The EMBO Journal, Vol. 17, No. 16, p. 4572-4584, 1998). Such structures are not naturally formed with ISU peptides of limited length, and this is most probably why most studies carried out with peptides provide irrelevant results and/or are dependent on specific coupling of the peptides to carrier proteins (such as BSA, e.g. Denner et al., Current Science, AIDS 1994, 8:1063-1072).

As mentioned above, the Env proteins according to the invention are mutated. This mutation is made in vitro. Thus, the mutated Env proteins according to the invention are isolated, and do not correspond to naturally occurring counterpart.

As mentioned above, the lentiviral mutated Env proteins have decreased immunosuppressive properties, substantially no immunosuppressive properties or no immunosuppressive properties. This means that the mutated Env proteins according to the invention have no, or have reduced immunosuppressive properties with respect to the natural non mutated Env proteins from a virus of the same species. For instance, a mutated FIV Env protein according to the invention has reduced immunosuppressive properties with respect to the wild type FIV Env protein.

In the invention, the terms "a decreased immunosuppressive activity, substantially no immunosuppressive activity or no immunosuppressive activity" means that the mutated Env proteins according to the invention have an immunosuppressive index less than about 50 or 25% of that of the wild type Env protein [Mangeney and Heidmann Proc Natl Acad Sci USA 1998; 95: 14920-14925; Mangeney et al. Proc Natl Acad Sci USA, 2007, 104(51):20534-9].

In the invention, structures responsible for the antigenicity of the mutated lentiviral ENV protein are essentially preserved.

As intended herein, the expression "structures responsible for antigenicity" relates to structures of the protein which are liable to interact with components of the immune system such as antibodies or membrane receptors of immune cells, in particular T cells.

The mutation(s) within the immunosuppressive domain of the lentiviral Env proteins is (are) sufficient to decrease the immunosuppressive activity of the mutated lentiviral Env protein with respect to the corresponding wild type Env. However, it might be advantageous that another amino acid be also mutated because it ensures that the structure of the mutated Env protein is essentially conserved with respect to the corresponding wild type Env protein.

The mutated lentiviral Env protein has substantially retained the structure, especially the antigenic structure, e.g., immunogenic determinants, of the original determined lentiviral Env protein, i.e. the wild type non mutated lentiviral Env protein.

These properties can be evaluated by testing the ability of the Env proteins to be normally expressed at the cell membrane under conditions which preserve the surface and transmembrane subunits (SU:TM) interactions and recognition by specific anti-Env antibodies, and by measuring the functional fusogenic activity of said mutated lentiviral Env with respect to the same properties in the wild type non mutated lentiviral Env protein (see examples).

Generally speaking, the mutated ENV protein involved in the present invention has an average length of about 750 to about 1000 amino acids.

The invention encompasses fragments of the mutated ENV protein as defined above, provided that said fragment:
    comprises at least the sequence SEQ ID NO: 1, as defined above, comprises at least 40 amino acids, preferably comprises at least 50 amino acids, has decreased immunosuppressive properties, substantially no immunosuppressive properties or no immunosuppressive properties, as defined above, preferably, comprises the extracellular parts of the ENV protein, retains the structure of the ENV protein from which it derives, harbours the same epitopes as the corresponding fragment in the wild type ENV protein.

According to a particular embodiment, the fragment of the mutated ENV protein of the invention can comprise about 40, 50, 100, 150, 200, 250, 300, 350, 400, 450, 500, 550, 600, 650, 700, 750, 800, 850, 900, 950 amino acids. These values are given only in an illustrative way, as the man skilled in the art will understand that the fragment can comprise any number of amino acids comprised from about 40 to about 950 amino acids.

Advantageously, the fragments according to the invention are such that, while retaining the antigenic structure of the full length mutated ENV protein, and thus of the wild type ENV protein, they have lost major antigenic regions that are responsible for antigenicity in another region than the region corresponding to the immunosuppressive domain, because said regions could be detrimental for targeting an immune response against the immunosuppressive domain.

The invention also relates to a pharmaceutical composition wherein the active substance is an isolated non naturally occurring feline lentiviral ENV protein having a decreased immunosuppressive activity, substantially no immunosuppressive activity or no immunosuppressive activity, as above defined, or fragments thereof.

In a particular embodiment, the invention relates to a pharmaceutical composition as defined above wherein:

$X_1$ is any amino acid different from E or deleted, and $X_2$, $X_3$, $X_4$ and $X_5$ are any amino acid, or $X_2$ is any amino acid different from K or deleted, and $X_1$, $X_3$, $X_4$ and $X_5$ are any amino acid, or $X_3$ is any amino acid different from F or deleted, and $X_1$, $X_2$, $X_4$ and $X_5$ are any amino acid, or $X_4$ is any amino acid different from L or deleted, and $X_1$, $X_2$, $X_3$ and $X_5$ are any amino acid, or $X_5$ is any amino acid different from Y or deleted, and $X_1$, $X_2$, $X_3$ and $X_4$ are any amino acid, or $X_1$ is any amino acid different from E or deleted, $X_2$ is any amino acid different from K or deleted, and $X_3$, $X_4$ and $X_5$ are any amino acid, or $X_1$ is any amino acid different from E or deleted, $X_3$ is any amino acid different from F or deleted, and $X_2$, $X_4$ and $X_5$ are any amino acid, or $X_1$ is any amino acid different from E or deleted, $X_4$ is any amino acid different from L or deleted, and $X_2$, $X_3$ and $X_5$ are any amino acid, or $X_1$ is any amino acid different from E or deleted, $X_5$ is any amino acid different from Y or deleted, and $X_2$, $X_3$ and $X_4$ are any amino acid, or $X_2$ is any amino acid different from K or deleted, $X_3$ is any amino acid different from F or deleted, and $X_1$, $X_4$ and $X_5$ are any amino acid, or $X_2$ is any amino acid different from K or deleted, $X_4$ is any amino acid different from L or deleted, and $X_2$, $X_4$ and $X_5$ are any amino acid, or $X_2$ is any amino acid different from K or deleted, $X_5$ is any amino acid different from Y or deleted, and $X_2$, $X_3$ and $X_4$ are any amino acid, or $X_3$ is any amino acid different from F or deleted, $X_4$ is any amino acid different from L or deleted, and $X_2$, $X_4$ and $X_5$ are any amino acid, or $X_3$ is any amino acid different from F or deleted, $X_5$ is any amino acid different from Y or deleted, and $X_2$, $X_3$ and $X_4$ are any amino acid, or $X_4$ is any amino acid different from L or deleted, $X_5$ is any amino acid different from Y or deleted, and $X_2$, $X_4$ and $X_5$ are any amino acid, or $X_1$ is any amino acid different from E or deleted, $X_2$ is any amino acid different from K or deleted, $X_3$ is any amino acid different from F or deleted, and $X_4$ and $X_5$ are any amino acid, or $X_1$ is any amino acid different from E or deleted, $X_2$ is any amino acid different from K or deleted, $X_4$ is any amino acid different from L or deleted, and $X_3$ and $X_5$ are any amino acid, or $X_1$ is any amino acid different from E or deleted, $X_2$ is any amino acid different from K or deleted, $X_5$ is any amino acid different from Y or deleted, and $X_3$ and $X_4$ are any amino acid, or $X_1$ is any amino acid different from E or deleted, $X_3$ is any amino acid different from F or deleted, $X_4$ is any amino acid different from L or deleted, and $X_2$ and $X_5$ are any amino acid, or $X_1$ is any amino acid different from E or deleted, $X_3$ is any amino acid different from F or deleted, $X_5$ is any amino acid different from Y or deleted, and $X_2$ and $X_4$ are any amino acid, or $X_1$ is any amino acid different from E or deleted, $X_4$ is any amino acid different from L or deleted, $X_5$ is any amino acid different from Y or deleted, and $X_2$ and $X_3$ are any amino acid, or $X_2$ is any amino acid different from K or deleted, $X_3$ is any amino acid different from F or deleted, $X_4$ is any amino acid different from L or deleted, and $X_1$ and $X_5$ are any amino acid, or $X_2$ is any amino acid different from K or deleted, $X_3$ is any amino acid different from F or deleted, $X_5$ is any amino acid different from Y or deleted, and $X_1$ and $X_4$ are any amino acid, or $X_2$ is any amino acid different from K or deleted, $X_4$ is any amino acid different from L or deleted, $X_5$ is any amino acid different from Y or deleted, and $X_1$ and $X_3$ are any amino acid, or $X_3$ is any amino acid different from F or deleted, $X_4$ is any amino acid different from L or deleted, $X_5$ is any amino acid different from Y or deleted, and $X_1$ and $X_2$ are any amino acid, or $X_1$ is any amino acid different from E or deleted, $X_2$ is any amino acid different from K or deleted, $X_3$ is any amino acid different from F or deleted, $X_4$ is any amino acid different from L or deleted, and $X_5$ is any amino acid, or $X_1$ is any amino acid different from E or deleted, $X_2$ is any amino acid different from K or deleted, $X_3$ is any amino acid different from F or deleted, $X_5$ is any amino acid different from Y or deleted, and $X_4$ is any amino acid, or $X_1$ is any amino acid different from E or deleted, $X_2$ is any amino acid different from K or deleted, $X_4$ is any amino acid different from L or deleted, $X_5$ is any amino acid different from Y or deleted, and $X_3$ is any amino acid, or $X_1$ is any amino acid different from E or deleted, $X_3$ is any amino acid different from F or deleted, $X_4$ is any amino acid different from L or deleted, $X_5$ is any amino acid different from Y or deleted, and $X_2$ is any amino acid, or $X_2$ is any amino acid different from K or deleted, $X_3$ is any amino acid different from F or deleted, $X_4$ is any amino acid different from L or deleted, $X_5$ is any amino acid different from Y or deleted and $X_1$ is any amino acid, or $X_1$ is any amino acid different from E or deleted, $X_2$ is any amino acid different from K or deleted, $X_3$ is any amino acid different from F or deleted, $X_4$ is any amino acid different from L or deleted and $X_5$ is any amino acid different from Y or deleted.

In a particular embodiment, the invention relates to a pharmaceutical composition as defined above, wherein said mutated immunosuppressive domain contains the amino acid sequence SEQ ID NO: 1 or SEQ ID NO: 3, wherein:

$X_1$ is A, F, G, L or R, $X_2$ is A, F, G, L or R, and $X_3$, $X_4$ and $X_5$ are any amino acid, or $X_1$ is A, F, G, L or R, $X_3$ is A, G, L or R, and $X_2$, $X_4$ and $X_5$ are any amino acid, or $X_1$ is A, F, G, L or R, $X_4$ is A, F, G or R, and $X_2$, $X_3$ and $X_5$ are any amino acid, or $X_1$ is A, F, G, L or R, $X_5$ is A, F, G, L or R, and $X_2$, $X_3$ and $X_4$ are any amino acid, or $X_2$ is A, F, G, L or R, $X_3$ is A, G, L or R, and $X_1$, $X_4$ and $X_5$ are any amino acid, or $X_2$ is A, F, G, L or R, $X_4$ is A, F, G or R, and $X_1$, $X_3$ and $X_5$ are any amino acid, or $X_2$ is A, F, G, L or R, $X_5$ is A, F, G, L or R, and $X_1$, $X_3$ and $X_4$ are any amino acid, or $X_3$ is A, G, L or R, $X_4$ is A, F, G or R, and $X_1$, $X_2$ and $X_5$ are any amino acid, or $X_3$ is A, G, L or R, $X_5$ is A, F, G, L or R, and $X_1$, $X_2$ and $X_4$ are any amino acid, or $X_4$ is A, F, G or R, $X_5$ is A, F, G, L or R, and $X_1$, $X_2$ and $X_3$ are any amino acid.

In another embodiment, the invention relates to a pharmaceutical composition as defined above, wherein:

$X_1$ is any amino acid different from E or deleted, and/or $X_2$ is any amino acid different from K, or deleted, and/or $X_3$ is any amino acid different from F, P or deleted, and/or $X_4$ is any amino acid different from L, V, I or deleted, and/or $X_5$ is any amino acid different from Y or deleted.

In another embodiment, the invention relates to a pharmaceutical composition as defined above, wherein:

$X_1$ is any amino acid different from E or deleted, and/or $X_2$ is any amino acid different from K, A, N, Y, R or deleted, and/or $X_3$ is any amino acid different from F, P or deleted, and/or $X_4$ is any amino acid different from L, V, I or deleted, and/or $X_5$ is any amino acid different from Y, K, E, Q, R, A or deleted.

In another embodiment, the invention relates to a pharmaceutical composition as defined above, wherein:

$X_1$ is R, G, L, A, F or deleted, and/or $X_2$ is R, G, L, A, F or deleted, and/or $X_3$ is R, G, L, A, or deleted, and/or $X_4$ is R, G, A, F or deleted, and/or $X_5$ is R, G, L, A, F or deleted.

In another embodiment, the invention relates to a pharmaceutical composition as defined above, wherein:

$X_1$ is R, G, L, A, F or deleted, and $X_2$, $X_3$, $X_4$ and $X_5$ are any amino acid, or $X_2$ is R, G, L, A, F or deleted, and $X_1$, $X_3$, $X_4$ and $X_5$ are any amino acid, or $X_3$ is R, G, L, A or deleted, and $X_1$, $X_2$, $X_4$ and $X_5$ are any amino acid, or $X_4$ is R, G, A, F or deleted, and $X_1$, $X_2$, $X_3$ and $X_5$ are any amino acid, or $X_5$ is R, G, L, A, F or deleted, and $X_1$, $X_2$, $X_3$ and $X_4$ are any amino acid, or $X_1$ is R, G, L, A, F or deleted, $X_2$ is R, G, L, A, F or deleted, and $X_3$, $X_4$ and $X_5$ are any amino acid, or $X_1$ is R, G, L, A, F or deleted, $X_3$ is R, G, L, A or deleted, and $X_2$, $X_4$ and $X_5$ are any amino acid, or $X_1$ is R, G, L, A, F or deleted, $X_4$ is R, G, A, F or deleted, and $X_2$, $X_3$ and $X_5$ are any amino acid, or $X_1$ is R, G, L, A, F or deleted, $X_5$ is R, G, L, A, F or deleted, and $X_2$, $X_3$ and $X_4$ are any amino acid, or $X_2$ is R, G, L, A, F or deleted, $X_3$ is R, G, L, A or deleted, and $X_1$, $X_4$ and $X_5$ are any amino acid, or $X_2$ is R, G, L, A, F or deleted, $X_4$ is R, G, A, F or deleted, and $X_2$, $X_4$ and $X_5$ are any amino acid, or $X_2$ is R, G, L, A, F or deleted, $X_5$ is R, G, L, A, F or deleted, and $X_2$, $X_3$ and $X_4$ are any amino acid, or $X_3$ is R, G, L, A or deleted, $X_4$ is R, G, A, F or deleted, and $X_2$, $X_4$ and $X_5$ are any amino acid, or $X_3$ is R, G, L, A or deleted, $X_5$ is R, G, L, A, F or deleted, and $X_2$, $X_3$ and $X_4$ are any amino acid, or $X_4$ is R, G, A, F or deleted, $X_5$ is R, G, L, A, F or deleted and $X_2$, $X_4$ and $X_5$ are any amino acid, or $X_1$ is R, G, L, A, F or deleted, $X_2$ is R, G, L, A, F or deleted, $X_3$ is R, G, L, A or deleted, and $X_4$ and $X_5$ are any amino acid, or $X_1$ is any amino acid different from E or deleted, $X_2$ is R, G, L, A, F or deleted, $X_4$ is R, G, A, F or deleted, and $X_3$ and $X_5$ are any amino acid, or $X_1$ is R, G, L, A, F or deleted, $X_2$ is R, G, L, A, F or deleted, $X_5$ is R, G, L, A, F or deleted and $X_3$ and $X_4$ are any amino acid, or $X_1$ is R, G, L, A, F or deleted, $X_3$ is R, G, L, A or deleted, $X_4$ is R, G, A, F or deleted, and $X_2$ and $X_5$ are any amino acid, or $X_1$ is R, G, L, A, F or deleted, $X_3$ is R, G, L, A or deleted, $X_5$ is R, G, L, A, F or deleted, and $X_2$ and $X_4$ are any amino acid, or $X_1$ is R, G, L, A, F or deleted, $X_4$ is R, G, A, F or deleted, $X_5$ is R, G, L, A, F or deleted, and $X_2$ and $X_3$ are any amino acid, or $X_2$ is R, G, L, A, F or deleted, $X_3$ is R, G, L, A or deleted, $X_4$ is R, G, A, F or deleted, and $X_1$ and $X_5$ are any amino acid, or $X_2$ is R, G, L, A, F or deleted, $X_3$ is R, G, L, A or deleted, $X_5$ is R, G, L, A, F or deleted, and $X_1$ and $X_4$ are any amino acid, or $X_2$ is R, G, L, A, F or deleted, $X_4$ is R, G, A, F or deleted, $X_5$ is R, G, L, A, F or deleted, and $X_1$ and $X_3$ are any amino acid, or $X_3$ is R, G, L, A or deleted, $X_4$ is R, G, A, F or deleted, $X_5$ is R, G, L, A, F or deleted, and $X_1$ and $X_2$ are any amino acid, or $X_1$ is R, G, L, A, F or deleted, $X_2$ is R, G, L, A, F or deleted, $X_3$ is R, G, L, A or deleted, $X_4$ is R, G, A, F or deleted, and $X_5$ is any amino acid, or $X_1$ is R, G, L, A, F or deleted, $X_2$ is R, G, L, A, F or deleted, $X_3$ is R, G, L, A or deleted, $X_5$ is R, G, L, A, F or deleted, and $X_4$ is any amino acid, or $X_1$ is R, G, L, A, F or deleted, $X_2$ is R, G, L, A, F or deleted, $X_4$ is R, G, A, F or deleted, $X_5$ is R, G, L, A, F or deleted, and $X_3$ is any amino acid, or $X_1$ is R, G, L, A, F or deleted, $X_3$ is R, G, L, A or deleted, $X_4$ is R, G, A, F or deleted, $X_5$ is R, G, L, A, F or deleted, and $X_2$ is any amino acid, or $X_2$ is R, G, L, A, F or deleted, $X_3$ is R, G, L, A or deleted, $X_4$ is R, G, A, F or deleted, $X_5$ is R, G, L, A, F or deleted, and $X_1$ is any amino acid, or $X_1$ is R, G, L, A, F or deleted, $X_2$ is R, G, L, A, F or deleted, $X_3$ is R, G, L, A or deleted, $X_4$ is R, G, A, F or deleted and $X_5$ is R, G, L, A, F or deleted.

In another embodiment, the invention relates to a pharmaceutical composition as defined above, wherein said mutated immunosuppressive domain contains the amino acid sequence SEQ ID NO: 1 or SEQ ID NO: 3, wherein:

$X_1$ is A, G or R, and $X_2$, $X_3$, $X_4$ and $X_5$ are any amino acid, or $X_2$ is A, G or R, and $X_1$, $X_3$, $X_4$ and $X_5$ are any amino acid, or $X_3$ is A, G or R, and $X_1$, $X_2$, $X_4$ and $X_5$ are any amino acid, or $X_4$ is A, G or R, and $X_1$, $X_2$, $X_3$ and $X_5$ are any amino acid, or $X_5$ is A, G or R, and $X_1$, $X_2$, $X_3$ and $X_4$ are any amino acid, in particular:

$X_1$ is R, and $X_2$, $X_3$, $X_4$ and $X_5$ are any amino acid, or
$X_2$ is R, and $X_1$, $X_3$, $X_4$ and $X_5$ are any amino acid, or
$X_3$ is R, and $X_1$, $X_2$, $X_4$ and $X_5$ are any amino acid, or
$X_4$ is R, and $X_1$, $X_2$, $X_3$ and $X_5$ are any amino acid, or
$X_5$ is R, and $X_1$, $X_2$, $X_3$ and $X_4$ are any amino acid.

In another embodiment, the invention relates to a pharmaceutical composition as defined above, wherein:

$X_1$ is R, G, L, A, F or deleted, and/or
$X_2$ is G, L, F or deleted, and/or
$X_3$ is R, G, L, A, or deleted, and/or
$X_4$ is R, G, A, F or deleted, and/or
$X_5$ is G, L, F or deleted.

In another embodiment, the invention relates to a pharmaceutical composition as defined above, wherein:

$X_3$ is A, G, L, R, C, D, E, H, K, M, N, Q, S, T, V, W, Y or deleted, $X_4$ is C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is A, F, G, R, C, D, E, H, K, M, N, P, Q, S, T, W, Y or deleted, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is A, G, L, R, C, D, E, H, K, M, N, Q, S, T, V, W, Y or deleted, $X_4$ is A, F, G, R, C, D, E, H, K, M, N, P, Q, S, T, W, Y or deleted, and $X_1$, $X_2$, $X_5$ are A, F, G, L, R, C, D, E, H, I, K, M, N, P, Q, 5, T, V, W or Y.

In another embodiment, the invention relates to a pharmaceutical composition as defined above, wherein:

$X_3$ is R, G, L, A or deleted, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, G, L, A, F or deleted, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, G, L, A or deleted, $X_4$ is R, G, A, F or deleted, and $X_1$, $X_2$, $X_5$ are A, F, G, L, R, C, D, E, H, I, K, M, N, P, Q, 5, T, V, W or Y.

In another embodiment, the invention relates to a pharmaceutical composition as defined above, wherein:

$X_3$ is R, A or deleted, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, A or deleted, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, A or deleted, $X_4$ is R, A or deleted, and $X_1$, $X_2$, $X_5$ are A, F, G, L, R, C, D, E, H, I, K, M, N, P, Q, 5, T, V, W or Y.

In another embodiment, the invention relates to a pharmaceutical composition as defined above, wherein said mutated immunosuppressive domain contains the amino acid sequence SEQ ID NO: 1 or SEQ ID NO: 3, wherein:

$X_1$ is A, G or R, $X_2$ is A, G or R, and $X_3$, $X_4$ and $X_5$ are any amino acid, or $X_1$ is A, G or R, $X_3$ is A, G or R, and $X_2$, $X_4$ and $X_5$ are any amino acid, or $X_1$ is A, G or R, $X_4$ is A, G or R, and $X_2$, $X_3$ and $X_5$ are any amino acid, or $X_1$ is A, G or R, $X_5$ is A, G or R, and $X_2$, $X_3$ and $X_4$ are any amino acid, or $X_2$ is A, G or R, $X_3$ is A, G or R, and $X_1$, $X_4$ and $X_5$ are any amino acid, or $X_2$ is A, G or R, $X_4$ is A, G or R, and $X_1$, $X_3$ and $X_5$ are any amino acid, or $X_2$ is A, G or R, $X_5$ is A, G or R, and $X_1$, $X_3$ and $X_4$ are any amino acid, or $X_3$ is A, G or R, $X_4$ is A, G or R, and $X_1$, $X_2$ and $X_5$ are any amino acid, or $X_3$ is A, G or R, $X_5$ is A, G or R, and $X_1$, $X_2$ and $X_4$ are any amino acid, or $X_4$ is A, G or R, $X_5$ is A, G or R, and $X_1$, $X_2$ and $X_3$ are any amino acid, in particular:

$X_1$ is R, $X_2$ is R, and $X_3$, $X_4$ and $X_5$ are any amino acid, or
$X_1$ is R, $X_3$ is R, and $X_2$, $X_4$ and $X_5$ are any amino acid, or
$X_1$ is R, $X_4$ is R, and $X_2$, $X_3$ and $X_5$ are any amino acid, or
$X_1$ is R, $X_5$ is R, and $X_2$, $X_3$ and $X_4$ are any amino acid, or
$X_2$ is R, $X_3$ is R, and $X_1$, $X_4$ and $X_5$ are any amino acid, or
$X_2$ is R, $X_4$ is R, and $X_1$, $X_3$ and $X_5$ are any amino acid, or
$X_2$ is R, $X_5$ is R, and $X_1$, $X_3$ and $X_4$ are any amino acid, or
$X_3$ is R, $X_4$ is R, and $X_1$, $X_2$ and $X_5$ are any amino acid, or
$X_3$ is R, $X_5$ is R, and $X_1$, $X_2$ and $X_4$ are any amino acid, or
$X_4$ is R, $X_5$ is R, and $X_1$, $X_2$ and $X_3$ are any amino acid.

In another embodiment, the invention relates to a pharmaceutical composition as defined above, wherein said mutated immunosuppressive domain contains the amino acid sequence SEQ ID NO: 1 or SEQ ID NO: 3, wherein: $X_1$ is A, G or R, and $X_2$, $X_3$, $X_4$ and $X_5$ are any amino acid different from A, G or R, or $X_2$ is A, G or R, and $X_1$, $X_3$, $X_4$ and $X_5$ are any amino acid different from A, G or R, or $X_3$ is A, G or R, and $X_1$, $X_2$, $X_4$ and $X_5$ are any amino acid different from A, G or R, or $X_4$ is A, G or R, and $X_1$, $X_2$, $X_3$ and $X_5$ are any amino acid different from A, G or R, or $X_5$ is A, G or R, and $X_1$, $X_2$, $X_3$ and $X_4$ are any amino acid different from A, G or R, in particular:

$X_1$ is R, and $X_2$, $X_3$, $X_4$ and $X_5$ are any amino acid different from A, G or R, or $X_2$ is R, and $X_1$, $X_3$, $X_4$ and $X_5$ are any amino acid different from A, G or R, or $X_3$ is R, and $X_1$, $X_2$, $X_4$ and $X_5$ are any amino acid different from A, G or R, or $X_4$ is R, and $X_1$, $X_2$, $X_3$ and $X_5$ are any amino acid different from A, G or R, or $X_5$ is R, and $X_1$, $X_2$, $X_3$ and $X_4$ are any amino acid different from A, G or R.

In another embodiment, the invention relates to a pharmaceutical composition as defined above, wherein said mutated immunosuppressive domain contains the amino acid sequence SEQ ID NO: 1 or SEQ ID NO: 3, wherein:

$X_1$ is A, G or R, $X_2$ is A, G or R, and $X_3$, $X_4$ and $X_5$ are any amino acid different from A, G or R, or $X_1$ is A, G or R, $X_3$ is A, G or R, and $X_2$, $X_4$ and $X_5$ are any amino acid different from A, G or R, or $X_1$ is A, G or R, $X_4$ is A, G or R, and $X_2$, $X_3$ and $X_5$ are any amino acid different from A, G or R, or $X_1$ is A, G or R, $X_5$ is A, G or R, and $X_2$, $X_3$ and $X_4$ are any amino acid different from A, G or R, or $X_2$ is A, G or R, $X_3$ is A, G or R, and $X_1$, $X_4$ and $X_5$ are any amino acid different from A, G or R, or $X_2$ is A, G or R, $X_4$ is A, G or R, and $X_1$, $X_3$ and $X_5$ are any amino acid different from A, G or R, or $X_2$ is A, G or R, $X_5$ is A, G or R, and $X_1$, $X_3$ and $X_4$ are any amino acid different from A, G or R, or $X_3$ is A, G or R, $X_4$ is A, G or R, and $X_1$, $X_2$ and $X_5$ are any amino acid different from A, G or R, or $X_3$ is A, G or R, $X_5$ is A, G or R, and $X_1$, $X_2$ and $X_4$ are any amino acid different from A, G or R, or $X_4$ is A, G or R, $X_5$ is A, G or R, and $X_1$, $X_2$ and $X_3$ are any amino acid different from A, G or R, in particular:

$X_1$ is R, $X_2$ is R, and $X_3$, $X_4$ and $X_5$ are any amino acid different from A, G or R, or $X_1$ is R, $X_3$ is R, and $X_2$, $X_4$ and $X_5$ are any amino acid different from A, G or R, or $X_1$ is R, $X_4$ is R, and $X_2$, $X_3$ and $X_5$ are any amino acid different from A, G or R, or $X_1$ is R, $X_5$ is R, and $X_2$, $X_3$ and $X_4$ are any amino acid different from A, G or R, or $X_2$ is R, $X_3$ is R, and $X_1$, $X_4$ and $X_5$ are any amino acid different from A, G or R, or $X_2$ is R, $X_4$ is R, and $X_1$, $X_3$ and $X_5$ are any amino acid different from A, G or R, or $X_2$ is R, $X_5$ is R, and $X_1$, $X_3$ and $X_4$ are any amino acid different from A, G or R, or $X_3$ is R, $X_4$ is R, and $X_1$, $X_2$ and $X_5$ are any amino acid different from A, G or R, or $X_3$ is R, $X_5$ is R, and $X_1$, $X_2$ and $X_4$ are any amino acid, different from A, G or R or $X_4$ is R, $X_5$ is R, and $X_1$, $X_2$ and $X_3$ are any amino acid different from A, G or R.

In another embodiment, the invention relates to a pharmaceutical composition as defined above, wherein:

$X_3$ is R, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, $X_4$ is R, and $X_1$, $X_2$, $X_5$ are A, F, G, L, R, C, D, E, H, I, K, M, N, P, Q, S, T, V, W or Y.

In another embodiment, the invention relates to a pharmaceutical composition as defined above, wherein:

$X_3$ is R, and $X_1$ is E, $X_2$ is K, $X_4$ is L, $X_5$ is Y, or $X_4$ is R, and $X_1$ is E, $X_2$ is K, $X_3$ is F, $X_5$ is Y, or $X_3$ is R, $X_4$ is R, and $X_1$ is E, $X_2$ is K, $X_5$ is Y.

In another embodiment, the invention relates to a pharmaceutical composition as defined above, wherein:

$X_3$ is R, and $X_1$, $X_2$, $X_4$, $X_5$ are A, F, G, L, R, C, D, E, H, I, K, M, N, P, Q, S, T, V, W or Y.

In another embodiment, the invention relates to a pharmaceutical composition as defined above, wherein:

$X_3$ is R, and $X_1$ is E, $X_2$ is K, $X_4$ is L, $X_5$ is Y.

In another embodiment, the invention relates to a pharmaceutical composition as defined above, wherein said mutated feline lentiviral ENV protein or fragment thereof comprising a mutated immunosuppressive domain (ISU) contains the following amino acid sequence:

```
                                      (SEQ ID NO: 489)
A-[I/M/T/L]-[A/G/R]-K-[F/P]-[L/V/I]-Y-T-A,
or
                                      (SEQ ID NO: 490)
A-[I/M/T/L]-E-[A/G/R]-[F/P]-[L/V/I]-Y-T-A,
or
                                      (SEQ ID NO: 491)
A-[I/M/T/L]-E-K-[A/G/R]-[L/V/I]-Y-T-A,
or
                                      (SEQ ID NO: 492)
A-[I/M/T/L]-E-K-[F/P]-[A/G/R]-Y-T-A,
or
                                      (SEQ ID NO: 493)
A-[I/M/T/L]-E-K-[F/P]-[L/V/I]-[A/G/R]-T-A,
or
                                      (SEQ ID NO: 494)
A-[I/M/T/L]-E-K-[A/G/R]-[A/G/R]-Y-T-A,
``` in particular:

```
                                      (SEQ ID NO: 489)
A-[I/M/T/L]-[A/G/R]-K-[F/P]-[L/V/I]-Y-T-A,
or
                                      (SEQ ID NO: 495)
A-[I/M/T/L]-E-G-[F/P]-[L/V/I]-Y-T-A,
or
                                      (SEQ ID NO: 491)
A-[I/M/T/L]-E-K-[A/G/R]-[L/V/I]-Y-T-A,
or
                                      (SEQ ID NO: 492)
A-[I/M/T/L]-E-K-[F/P]-[A/G/R]-Y-T-A,
or
                                      (SEQ ID NO: 496)
A-[I/M/T/L]-E-K-[F/P]-[L/V/I]-G-T-A,
or
                                      (SEQ ID NO: 494)
A-[I/M/T/L]-E-K-[A/G/R]-[A/G/R]-Y-T-A.
```

In another embodiment, the invention relates to a pharmaceutical composition as defined above, wherein said mutated feline lentiviral ENV protein or fragment thereof comprising a mutated immunosuppressive domain (ISU) contains the following amino acid sequence:

```
                                      (SEQ ID NO: 497)
A-[I/M/T/L]-R-K-[F/P]-[L/V/I]-Y-T-A,
or
```

(SEQ ID NO: 498)
A-[I/M/T/L]-E-R-[F/P]-[L/V/I]-Y-T-A,
or (SEQ ID NO: 499)
A-[I/M/T/L]-E-K-R-[L/V/I]-Y-T-A,
or (SEQ ID NO: 500)
A-[I/M/T/L]-E-K-[F/P]-R-Y-T-A,
or (SEQ ID NO: 501)
A-[I/M/T/L]-E-K-[F/P]-[L/V/I]-R-T-A,
or (SEQ ID NO: 502)
A-[I/M/T/L]-E-K-R-R-Y-T-A.

In another embodiment, the invention relates to a pharmaceutical composition as defined above, wherein said isolated mutated feline lentiviral ENV protein or said fragment thereof, comprises one of the amino acid sequences SEQ ID NO: 28 to 171.

In the invention "SEQ ID NO: 28 to 171" encompasses SEQ ID NO: 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170 and 171.

The correspondence is the following one:

SEQ ID NO: 28
AIEKRLYTA

SEQ ID NO: 29
AMEKRLYTA

SEQ ID NO: 30
ATEKRLYTA

SEQ ID NO: 31
ALEKRLYTA

SEQ ID NO: 32
AIEKRVYTA

SEQ ID NO: 33
AMEKRVYTA

SEQ ID NO: 34
ATEKRVYTA

SEQ ID NO: 35
ALEKRVYTA

SEQ ID NO: 36
AIEKRIYTA

SEQ ID NO: 37
AMEKRIYTA

SEQ ID NO: 38
ATEKRIYTA

SEQ ID NO: 39
ALEKRIYTA

SEQ ID NO: 40
AIEKGLYTA

SEQ ID NO: 41
AMEKGLYTA

SEQ ID NO: 42
ATEKGLYTA

SEQ ID NO: 43
ALEKGLYTA

SEQ ID NO: 44
AIEKGVYTA

SEQ ID NO: 45
AMEKGVYTA

SEQ ID NO: 46
ATEKGVYTA

SEQ ID NO: 47
ALEKGVYTA

SEQ ID NO: 48
AIEKGIYTA

SEQ ID NO: 49
AMEKGIYTA

SEQ ID NO: 50
ATEKGIYTA

SEQ ID NO: 51
ALEKGIYTA

SEQ ID NO: 52
AIEKLLYTA

SEQ ID NO: 53
AMEKLLYTA

SEQ ID NO: 54
ATEKLLYTA

SEQ ID NO: 55
ALEKLLYTA

SEQ ID NO: 56
AIEKLVYTA

SEQ ID NO: 57
AMEKLVYTA

SEQ ID NO: 58
ATEKLVYTA

SEQ ID NO: 59
ALEKLVYTA

SEQ ID NO: 60
AIEKLIYTA

SEQ ID NO: 61
AMEKLIYTA

SEQ ID NO: 62
ATEKLIYTA

SEQ ID NO: 63
ALEKLIYTA

SEQ ID NO: 64
AIEKALYTA

SEQ ID NO: 65
AMEKALYTA

SEQ ID NO: 66
ATEKALYTA

-continued

ALEKALYTA SEQ ID NO: 67

AIEKAVYTA SEQ ID NO: 68

AMEKAVYTA SEQ ID NO: 69

ATEKAVYTA SEQ ID NO: 70

ALEKAVYTA SEQ ID NO: 71

AIEKLIYTA SEQ ID NO: 72

AMEKAIYTA SEQ ID NO: 73

ATEKAIYTA SEQ ID NO: 74

ALEKAIYTA SEQ ID NO: 75

AIEKFRYTA SEQ ID NO: 76

AMEKFRYTA SEQ ID NO: 77

ATEKFRYTA SEQ ID NO: 78

ALEKFRYTA SEQ ID NO: 79

AIEKPRYTA SEQ ID NO: 80

AMEKPRYTA SEQ ID NO: 81

ATEKPRYTA SEQ ID NO: 82

ALEKPRYTA SEQ ID NO: 83

AIEKFGYTA SEQ ID NO: 84

AMEKFGYTA SEQ ID NO: 85

ATEKFGYTA SEQ ID NO: 86

ALEKFGYTA SEQ ID NO: 87

AIEKPGYTA SEQ ID NO: 88

AMEKPGYTA SEQ ID NO: 89

ATEKPGYTA SEQ ID NO: 90

ALEKPGYTA SEQ ID NO: 91

AIEKFFYTA SEQ ID NO: 92

AMEKFFYTA SEQ ID NO: 93

-continued

ATEKFFYTA SEQ ID NO: 94

ALEKFFYTA SEQ ID NO: 95

AIEKPFYTA SEQ ID NO: 96

AMEKPFYTA SEQ ID NO: 97

ATEKPFYTA SEQ ID NO: 98

ALEKPFYTA SEQ ID NO: 99

AIEKFAYTA SEQ ID NO: 100

AMEKFAYTA SEQ ID NO: 101

ATEKFAYTA SEQ ID NO: 102

ALEKFAYTA SEQ ID NO: 103

AIEKPAYTA SEQ ID NO: 104

AMEKPAYTA SEQ ID NO: 105

ATEKPAYTA SEQ ID NO: 106

ALEKPAYTA SEQ ID NO: 107

AIEKRRYTA SEQ ID NO: 108

AMEKRRYTA SEQ ID NO: 109

ATEKRRYTA SEQ ID NO: 110

ALEKRRYTA SEQ ID NO: 111

AIEKRAYTA SEQ ID NO: 112

AMEKRAYTA SEQ ID NO: 113

ATEKRAYTA SEQ ID NO: 114

ALEKRAYTA SEQ ID NO: 115

AIEKRFYTA SEQ ID NO: 116

AMEKRFYTA SEQ ID NO: 117

ATEKRFYTA SEQ ID NO: 118

ALEKRFYTA SEQ ID NO: 119

AIEKRGYTA SEQ ID NO: 120

-continued

| Sequence | SEQ ID NO |
|---|---|
| AMEKRGYTA | 121 |
| ATEKRGYTA | 122 |
| ALEKRGYTA | 123 |
| AIEKARYTA | 124 |
| AMEKARYTA | 125 |
| ATEKARYTA | 126 |
| ALEKARYTA | 127 |
| AIEKAAYTA | 128 |
| AMEKAAYTA | 129 |
| ATEKAAYTA | 130 |
| ALEKAAYTA | 131 |
| AIEKAFYTA | 132 |
| AMEKAFYTA | 133 |
| ATEKAFYTA | 134 |
| ALEKAFYTA | 135 |
| AIEKAGYTA | 136 |
| AMEKAGYTA | 137 |
| ATEKAGYTA | 138 |
| ALEKAGYTA | 139 |
| AIEKGRYTA | 140 |
| AMEKGRYTA | 141 |
| ATEKGRYTA | 142 |
| ALEKGRYTA | 143 |
| AIEKGAYTA | 144 |
| AMEKGAYTA | 145 |
| ATEKGAYTA | 146 |
| ALEKGAYTA | 147 |
| AIEKGFYTA | 148 |
| AMEKGFYTA | 149 |
| ATEKGFYTA | 150 |
| ALEKGFYTA | 151 |
| AIEKGGYTA | 152 |
| AMEKGGYTA | 153 |
| ATEKGGYTA | 154 |
| ALEKGGYTA | 155 |
| AIEKFRYTA | 156 |
| AMEKFRYTA | 157 |
| ATEKFRYTA | 158 |
| ALEKFRYTA | 159 |
| AIEKFAYTA | 160 |
| AMEKFAYTA | 161 |
| ATEKFAYTA | 162 |
| ALEKFAYTA | 163 |
| AIEKFFYTA | 164 |
| AMEKFFYTA | 165 |
| ATEKFFYTA | 166 |
| ALEKFFYTA | 167 |
| AIEKFGYTA | 168 |
| AMEKFGYTA | 169 |
| ATEKFGYTA | 170 |
| ALEKFGYTA | 171 |

In another embodiment, the invention relates to a pharmaceutical composition as defined above, wherein said fragment of said isolated mutated feline lentiviral ENV protein comprises at least 40 amino acids, in particular at least 60 amino acids.

In another embodiment, the invention relates to a pharmaceutical composition as defined above, wherein said isolated mutated feline lentiviral ENV protein or said fragment thereof, comprises one of the amino acid sequences SEQ ID NO: 172 to 315.

In the invention "SEQ ID NO: 172 to 315" encompasses SEQ ID NO: 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314 and 315.

The correspondence is the following one:

SEQ ID NO: 172
AIEKVTGALKINNLRLVTLEHQVLVIGLKVEAIEKRLYT

AFAMQELGCNQNQFFCKIPLELWTR

SEQ ID NO: 173
AIEKVTGALKINNLRLVTLEHQVLVIGLKVEAMEKRLY

TAFAMQELGCNQNQFFCKIPLELWTR

SEQ ID NO: 174
AIEKVTGALKINNLRLVTLEHQVLVIGLKVEATEKRLYT

AFAMQELGCNQNQFFCKIPLELWTR

SEQ ID NO: 175
AIEKVTGALKINNLRLVTLEHQVLVIGLKVEALEKRLYT

AFAMQELGCNQNQFFCKIPLELWTR

SEQ ID NO: 176
AIEKVTGALKINNLRLVTLEHQVLVIGLKVEAIEKRVYT

AFAMQELGCNQNQFFCKIPLELWTR

SEQ ID NO: 177
AIEKVTGALKINNLRLVTLEHQVLVIGLKVEAMEKRVY

TAFAMQELGCNQNQFFCKIPLELWTR

SEQ ID NO: 178
AIEKVTGALKINNLRLVTLEHQVLVIGLKVEATEKRVY

TAFAMQELGCNQNQFFCKIPLELWTR

SEQ ID NO: 179
AIEKVTGALKINNLRLVTLEHQVLVIGLKVEALEKRVY

TAFAMQELGCNQNQFFCKIPLELWTR

SEQ ID NO: 180
AIEKVTGALKINNLRLVTLEHQVLVIGLKVEAIEKRIYT

AFAMQELGCNQNQFFCKIPLELWTR

SEQ ID NO: 181
AIEKVTGALKINNLRLVTLEHQVLVIGLKVEAMEKRIYT

AFAMQELGCNQNQFFCKIPLELWTR

SEQ ID NO: 182
AIEKVTGALKINNLRLVTLEHQVLVIGLKVEATEKRIYT

AFAMQELGCNQNQFFCKIPLELWTR

-continued

SEQ ID NO: 183
AIEKVTGALKINNLRLVTLEHQVLVIGLKVEALEKRIYT

AFAMQELGCNQNQFFCKIPLELWTR

SEQ ID NO: 184
AIEKVTGALKINNLRLVTLEHQVLVIGLKVEAIEKGLYT

AFAMQELGCNQNQFFCKIPLELWTR

SEQ ID NO: 185
AIEKVTGALKINNLRLVTLEHQVLVIGLKVEAMEKGLY

TAFAMQELGCNQNQFFCKIPLELWTR

SEQ ID NO: 186
AIEKVTGALKINNLRLVTLEHQVLVIGLKVEATEKGLYT

AFAMQELGCNQNQFFCKIPLELWTR

SEQ ID NO: 187
AIEKVTGALKINNLRLVTLEHQVLVIGLKVEALEKGLYT

AFAMQELGCNQNQFFCKIPLELWTR

SEQ ID NO: 188
AIEKVTGALKINNLRLVTLEHQVLVIGLKVEAIEKGVYT

AFAMQELGCNQNQFFCKIPLELWTR

SEQ ID NO: 189
AAIEKVTGALKINNLRLVTLEHQVLVIGLKVEMEKGVY

TAFAMQELGCNQNQFFCKIPLELWTR

SEQ ID NO: 190
AIEKVTGALKINNLRLVTLEHQVLVIGLKVEATEKGVY

TAFAMQELGCNQNQFFCKIPLELWTR

SEQ ID NO: 191
AIEKVTGALKINNLRLVTLEHQVLVIGLKVEALEKGVY

TAFAMQELGCNQNQFFCKIPLELWTR

SEQ ID NO: 192
AIEKVTGALKINNLRLVTLEHQVLVIGLKVEAIEKGIYT

AFAMQELGCNQNQFFCKIPLELWTR

SEQ ID NO: 193
AIEKVTGALKINNLRLVTLEHQVLVIGLKVEAMEKGIYT

AFAMQELGCNQNQFFCKIPLELWTR

SEQ ID NO: 194
AIEKVTGALKINNLRLVTLEHQVLVIGLKVEATEKGIYT

AFAMQELGCNQNQFFCKIPLELWTR

SEQ ID NO: 195
AIEKVTGALKINNLRLVTLEHQVLVIGLKVEALEKGIYT

AFAMQELGCNQNQFFCKIPLELWTR

SEQ ID NO: 196
AIEKVTGALKINNLRLVTLEHQVLVIGLKVEAIEKLLYT

AFAMQELGCNQNQFFCKIPLELWTR

SEQ ID NO: 197
AIEKVTGALKINNLRLVTLEHQVLVIGLKVEAMEKLLY

TAFAMQELGCNQNQFFCKIPLELWTR

SEQ ID NO: 198
AIEKVTGALKINNLRLVTLEHQVLVIGLKVEATEKLLYT

AFAMQELGCNQNQFFCKIPLELWTR

-continued

SEQ ID NO: 199
AIEKVTGALKINNLRLVTLEHQVLVIGLKVEALEKLLYT
AFAMQELGCNQNQFFCKIPLELWTR

SEQ ID NO: 200
AIEKVTGALKINNLRLVTLEHQVLVIGLKVEAIEKLVYT
AFAMQELGCNQNQFFCKIPLELWTR

SEQ ID NO: 201
AIEKVTGALKINNLRLVTLEHQVLVIGLKVEAMEKLVY
TAFAMQELGCNQNQFFCKIPLELWTR

SEQ ID NO: 202
AIEKVTGALKINNLRLVTLEHQVLVIGLKVEATEKLVYT
AFAMQELGCNQNQFFCKIPLELWTR

SEQ ID NO: 203
AIEKVTGALKINNLRLVTLEHQVLVIGLKVEALEKLVYT
AFAMQELGCNQNQFFCKIPLELWTR

SEQ ID NO: 204
AIEKVTGALKINNLRLVTLEHQVLVIGLKVEAIEKLIYT
AFAMQELGCNQNQFFCKIPLELWTR

SEQ ID NO: 205
AIEKVTGALKINNLRLVTLEHQVLVIGLKVEAMEKLIYT
AFAMQELGCNQNQFFCKIPLELWTR

SEQ ID NO: 206
AIEKVTGALKINNLRLVTLEHQVLVIGLKVEATEKLIYT
AFAMQELGCNQNQFFCKIPLELWTR

SEQ ID NO: 207
AIEKVTGALKINNLRLVTLEHQVLVIGLKVEALEKLIYT
AFAMQELGCNQNQFFCKIPLELWTR

SEQ ID NO: 208
AIEKVTGALKINNLRLVTLEHQVLVIGLKVEAIEKALYT
AFAMQELGCNQNQFFCKIPLELWTR

SEQ ID NO: 209
AIEKVTGALKINNLRLVTLEHQVLVIGLKVEAMEKALY
TAFAMQELGCNQNQFFCKIPLELWTR

SEQ ID NO: 210
AIEKVTGALKINNLRLVTLEHQVLVIGLKVEATEKALYT
AFAMQELGCNQNQFFCKIPLELWTR

SEQ ID NO: 211
AIEKVTGALKINNLRLVTLEHQVLVIGLKVEALEKALYT
AFAMQELGCNQNQFFCKIPLELWTR

SEQ ID NO: 212
AIEKVTGALKINNLRLVTLEHQVLVIGLKVEAIEKAVYT
AFAMQELGCNQNQFFCKIPLELWTR

SEQ ID NO: 213
AIEKVTGALKINNLRLVTLEHQVLVIGLKVEAMEKAVY
TAFAMQELGCNQNQFFCKIPLELWTR

SEQ ID NO: 214
AIEKVTGALKINNLRLVTLEHQVLVIGLKVEATEKAVY
TAFAMQELGCNQNQFFCKIPLELWTR

SEQ ID NO: 215
AIEKVTGALKINNLRLVTLEHQVLVIGLKVEALEKAVY
TAFAMQELGCNQNQFFCKIPLELWTR

SEQ ID NO: 216
AIEKVTGALKINNLRLVTLEHQVLVIGLKVEAIEKAIYT
AFAMQELGCNQNQFFCKIPLELWTR

SEQ ID NO: 217
AIEKVTGALKINNLRLVTLEHQVLVIGLKVEAMEKAIYT
AFAMQELGCNQNQFFCKIPLELWTR

SEQ ID NO: 218
AIEKVTGALKINNLRLVTLEHQVLVIGLKVEATEKAIYT
AFAMQELGCNQNQFFCKIPLELWTR

SEQ ID NO: 219
AIEKVTGALKINNLRLVTLEHQVLVIGLKVEALEKAIYT
AFAMQELGCNQNQFFCKIPLELWTR

SEQ ID NO: 220
AIEKVTGALKINNLRLVTLEHQVLVIGLKVEAIEKFRYT
AFAMQELGCNQNQFFCKIPLELWTR

SEQ ID NO: 221
AIEKVTGALKINNLRLVTLEHQVLVIGLKVEAMEKFRY
TAFAMQELGCNQNQFFCKIPLELWTR

SEQ ID NO: 222
AIEKVTGALKINNLRLVTLEHQVLVIGLKVEATEKFRYT
AFAMQELGCNQNQFFCKIPLELWTR

SEQ ID NO: 223
AIEKVTGALKINNLRLVTLEHQVLVIGLKVEALEKFRYT
AFAMQELGCNQNQFFCKIPLELWTR

SEQ ID NO: 224
AIEKVTGALKINNLRLVTLEHQVLVIGLKVEAIEKPRYT
AFAMQELGCNQNQFFCKIPLELWTR

SEQ ID NO: 225
AIEKVTGALKINNLRLVTLEHQVLVIGLKVEAMEKPRY
TAFAMQELGCNQNQFFCKIPLELWTR

SEQ ID NO: 226
AIEKVTGALKINNLRLVTLEHQVLVIGLKVEATEKPRYT
AFAMQELGCNQNQFFCKIPLELWTR

SEQ ID NO: 227
AIEKVTGALKINNLRLVTLEHQVLVIGLKVEALEKPRYT
AFAMQELGCNQNQFFCKIPLELWTR

SEQ ID NO: 228
AIEKVTGALKINNLRLVTLEHQVLVIGLKVEAIEKFGYT
AFAMQELGCNQNQFFCKIPLELWTR

SEQ ID NO: 229
AIEKVTGALKINNLRLVTLEHQVLVIGLKVEAMEKFGY
TAFAMQELGCNQNQFFCKIPLELWTR

SEQ ID NO: 230
AIEKVTGALKINNLRLVTLEHQVLVIGLKVEATEKFGYT
AFAMQELGCNQNQFFCKIPLELWTR

SEQ ID NO: 231
AIEKVTGALKINNLRLVTLEHQVLVIGLKVEALEKFGYT
AFAMQELGCNQNQFFCKIPLELWTR

SEQ ID NO: 232
AIEKVTGALKINNLRLVTLEHQVLVIGLKVEAIEKPGYT
AFAMQELGCNQNQFFCKIPLELWTR

SEQ ID NO: 233
AIEKVTGALKINNLRLVTLEHQVLVIGLKVEAMEKPGY
TAFAMQELGCNQNQFFCKIPLELWTR

SEQ ID NO: 234
AIEKVTGALKINNLRLVTLEHQVLVIGLKVEATEKPGYT
AFAMQELGCNQNQFFCKIPLELWTR

SEQ ID NO: 235
AIEKVTGALKINNLRLVTLEHQVLVIGLKVEALEKPGYT
AFAMQELGCNQNQFFCKIPLELWTR

SEQ ID NO: 236
AIEKVTGALKINNLRLVTLEHQVLVIGLKVEAIEKFFYT
AFAMQELGCNQNQFFCKIPLELWTR

SEQ ID NO: 237
AIEKVTGALKINNLRLVTLEHQVLVIGLKVEAMEKFFY
TAFAMQELGCNQNQFFCKIPLELWTR

SEQ ID NO: 238
AIEKVTGALKINNLRLVTLEHQVLVIGLKVEATEKFFYT
AFAMQELGCNQNQFFCKIPLELWTR

SEQ ID NO: 239
AIEKVTGALKINNLRLVTLEHQVLVIGLKVEALEKFFYT
AFAMQELGCNQNQFFCKIPLELWTR

SEQ ID NO: 240
AIEKVTGALKINNLRLVTLEHQVLVIGLKVEAIEKPFYT
AFAMQELGCNQNQFFCKIPLELWTR

SEQ ID NO: 241
AIEKVTGALKINNLRLVTLEHQVLVIGLKVEAMEKPFY
TAFAMQELGCNQNQFFCKIPLELWTR

SEQ ID NO: 242
AIEKVTGALKINNLRLVTLEHQVLVIGLKVEATEKPFYT
AFAMQELGCNQNQFFCKIPLELWTR

SEQ ID NO: 243
AIEKVTGALKINNLRLVTLEHQVLVIGLKVEALEKPFYT
AFAMQELGCNQNQFFCKIPLELWTR

SEQ ID NO: 244
AIEKVTGALKINNLRLVTLEHQVLVIGLKVEAIEKFAYT
AFAMQELGCNQNQFFCKIPLELWTR

SEQ ID NO: 245
AIEKVTGALKINNLRLVTLEHQVLVIGLKVEAMEKPAY
TAFAMQELGCNQNQFFCKIPLELWTR

SEQ ID NO: 246
AIEKVTGALKINNLRLVTLEHQVLVIGLKVEATEKFAYT
AFAMQELGCNQNQFFCKIPLELWTR

SEQ ID NO: 247
AIEKVTGALKINNLRLVTLEHQVLVIGLKVEALEKFAYT
AFAMQELGCNQNQFFCKIPLELWTR

SEQ ID NO: 248
AIEKVTGALKINNLRLVTLEHQVLVIGLKVEAIEKPAYT
AFAMQELGCNQNQFFCKIPLELWTR

SEQ ID NO: 249
AIEKVTGALKINNLRLVTLEHQVLVIGLKVEAMEKPAY
TAFAMQELGCNQNQFFCKIPLELWTR

SEQ ID NO: 250
AIEKVTGALKINNLRLVTLEHQVLVIGLKVEATEKPAYT
AFAMQELGCNQNQFFCKIPLELWTR

SEQ ID NO: 251
AIEKVTGALKINNLRLVTLEHQVLVIGLKVEALEKPAYT
AFAMQELGCNQNQFFCKIPLELWTR

SEQ ID NO: 252
AIEKVTGALKINNLRLVTLEHQVLVIGLKVEAIEKRRYT
AFAMQELGCNQNQFFCKIPLELWTR

SEQ ID NO: 253
AIEKVTGALKINNLRLVTLEHQVLVIGLKVEAMEKRRY
TAFAMQELGCNQNQFFCKIPLELWTR

SEQ ID NO: 254
AIEKVTGALKINNLRLVTLEHQVLVIGLKVEATEKRRYT
AFAMQELGCNQNQFFCKIPLELWTR

SEQ ID NO: 255
AIEKVTGALKINNLRLVTLEHQVLVIGLKVEALEKRRYT
AFAMQELGCNQNQFFCKIPLELWTR

SEQ ID NO: 256
AIEKVTGALKINNLRLVTLEHQVLVIGLKVEAIEKRAYT
AFAMQELGCNQNQFFCKIPLELWTR

SEQ ID NO: 257
AIEKVTGALKINNLRLVTLEHQVLVIGLKVEAMEKRAY
TAFAMQELGCNQNQFFCKIPLELWTR

SEQ ID NO: 258
AIEKVTGALKINNLRLVTLEHQVLVIGLKVEATEKRAY
TAFAMQELGCNQNQFFCKIPLELWTR

SEQ ID NO: 259
AIEKVTGALKINNLRLVTLEHQVLVIGLKVEALEKRAY
TAFAMQELGCNQNQFFCKIPLELWTR

SEQ ID NO: 260
AIEKVTGALKINNLRLVTLEHQVLVIGLKVEAIEKRFYT
AFAMQELGCNQNQFFCKIPLELWTR

SEQ ID NO: 261
AIEKVTGALKINNLRLVTLEHQVLVIGLKVEAMEKRFY
TAFAMQELGCNQNQFFCKIPLELWTR

SEQ ID NO: 262
AIEKVTGALKINNLRLVTLEHQVLVIGLKVEATEKRFYT
AFAMQELGCNQNQFFCKIPLELWTR

SEQ ID NO: 263
AIEKVTGALKINNLRLVTLEHQVLVIGLKVEALEKRFYT
AFAMQELGCNQNQFFCKIPLELWTR

SEQ ID NO: 264
AIEKVTGALKINNLRLVTLEHQVLVIGLKVEAIEKRGYT
AFAMQELGCNQNQFFCKIPLELWTR

SEQ ID NO: 265
AIEKVTGALKINNLRLVTLEHQVLVIGLKVEAMEKRGY
TAFAMQELGCNQNQFFCKIPLELWTR

SEQ ID NO: 266
AIEKVTGALKINNLRLVTLEHQVLVIGLKVEATEKRGY
TAFAMQELGCNQNQFFCKIPLELWTR

SEQ ID NO: 267
AIEKVTGALKINNLRLVTLEHQVLVIGLKVEALEKRGY
TAFAMQELGCNQNQFFCKIPLELWTR

SEQ ID NO: 268
AIEKVTGALKINNLRLVTLEHQVLVIGLKVEAIEKARYT
AFAMQELGCNQNQFFCKIPLELWTR

SEQ ID NO: 269
AIEKVTGALKINNLRLVTLEHQVLVIGLKVEAMEKARY
TAFAMQELGCNQNQFFCKIPLELWTR

SEQ ID NO: 270
AIEKVTGALKINNLRLVTLEHQVLVIGLKVEATEKARY
TAFAMQELGCNQNQFFCKIPLELWTR

SEQ ID NO: 271
AIEKVTGALKINNLRLVTLEHQVLVIGLKVEALEKARY
TAFAMQELGCNQNQFFCKIPLELWTR

SEQ ID NO: 272
AIEKVTGALKINNLRLVTLEHQVLVIGLKVEAIEKAAYT
AFAMQELGCNQNQFFCKIPLELWTR

SEQ ID NO: 273
AIEKVTGALKINNLRLVTLEHQVLVIGLKVEAMEKAAY
TAFAMQELGCNQNQFFCKIPLELWTR

SEQ ID NO: 274
AIEKVTGALKINNLRLVTLEHQVLVIGLKVEATEKAAY
TAFAMQELGCNQNQFFCKIPLELWTR

SEQ ID NO: 275
AIEKVTGALKINNLRLVTLEHQVLVIGLKVEALEKAAY
TAFAMQELGCNQNQFFCKIPLELWTR

SEQ ID NO: 276
AIEKVTGALKINNLRLVTLEHQVLVIGLKVEAIEKAFYT
AFAMQELGCNQNQFFCKIPLELWTR

SEQ ID NO: 277
AIEKVTGALKINNLRLVTLEHQVLVIGLKVEAMEKAFY
TAFAMQELGCNQNQFFCKIPLELWTR

SEQ ID NO: 278
AIEKVTGALKINNLRLVTLEHQVLVIGLKVEATEKAFYT
AFAMQELGCNQNQFFCKIPLELWTR

SEQ ID NO: 279
AIEKVTGALKINNLRLVTLEHQVLVIGLKVEALEKAFYT
AFAMQELGCNQNQFFCKIPLELWTR

SEQ ID NO: 280
AIEKVTGALKINNLRLVTLEHQVLVIGLKVEAIEKAGYT
AFAMQELGCNQNQFFCKIPLELWTR

SEQ ID NO: 281
AIEKVTGALKINNLRLVTLEHQVLVIGLKVEAMEKAGY
TAFAMQELGCNQNQFFCKIPLELWTR

SEQ ID NO: 282
AIEKVTGALKINNLRLVTLEHQVLVIGLKVEATEKAGY
TAFAMQELGCNQNQFFCKIPLELWTR

SEQ ID NO: 283
AIEKVTGALKINNLRLVTLEHQVLVIGLKVEALEKAGY
TAFAMQELGCNQNQFFCKIPLELWTR

SEQ ID NO: 284
AIEKVTGALKINNLRLVTLEHQVLVIGLKVEAIEKGRYT
AFAMQELGCNQNQFFCKIPLELWTR

SEQ ID NO: 285
AIEKVTGALKINNLRLVTLEHQVLVIGLKVEAMEKGRY
TAFAMQELGCNQNQFFCKIPLELWTR

SEQ ID NO: 286
AIEKVTGALKINNLRLVTLEHQVLVIGLKVEATEKGRY
TAFAMQELGCNQNQFFCKIPLELWTR

SEQ ID NO: 287
AIEKVTGALKINNLRLVTLEHQVLVIGLKVEALEKGRY
TAFAMQELGCNQNQFFCKIPLELWTR

SEQ ID NO: 288
AIEKVTGALKINNLRLVTLEHQVLVIGLKVEAIEKGAYT
AFAMQELGCNQNQFFCKIPLELWTR

SEQ ID NO: 289
AIEKVTGALKINNLRLVTLEHQVLVIGLKVEAMEKGAY
TAFAMQELGCNQNQFFCKIPLELWTR

SEQ ID NO: 290
AIEKVTGALKINNLRLVTLEHQVLVIGLKVEATEKGAY
TAFAMQELGCNQNQFFCKIPLELWTR

SEQ ID NO: 291
AIEKVTGALKINNLRLVTLEHQVLVIGLKVEALEKGAY
TAFAMQELGCNQNQFFCKIPLELWTR

SEQ ID NO: 292
AIEKVTGALKINNLRLVTLEHQVLVIGLKVEAIEKGFYT
AFAMQELGCNQNQFFCKIPLELWTR

SEQ ID NO: 293
AIEKVTGALKINNLRLVTLEHQVLVIGLKVEAMEKGFY
TAFAMQELGCNQNQFFCKIPLELWTR

SEQ ID NO: 294
AIEKVTGALKINNLRLVTLEHQVLVIGLKVEATEKGFYT
AFAMQELGCNQNQFFCKIPLELWTR

```
                                   SEQ ID NO: 295
AIEKVTGALKINNLRLVTLEHQVLVIGLKVEALEKGFYT

AFAMQELGCNQNQFFCKIPLELWTR

SEQ ID NO: 296
AIEKVTGALKINNLRLVTLEHQVLVIGLKVEAIEKGGYT

AFAMQELGCNQNQFFCKIPLELWTR

SEQ ID NO: 297
AIEKVTGALKINNLRLVTLEHQVLVIGLKVEAMEKGGY

TAFAMQELGCNQNQFFCKIPLELWTR

SEQ ID NO: 298
AIEKVTGALKINNLRLVTLEHQVLVIGLKVEATEKGGY

TAFAMQELGCNQNQFFCKIPLELWTR

SEQ ID NO: 299
AIEKVTGALKINNLRLVTLEHQVLVIGLKVEALEKGGY

TAFAMQELGCNQNQFFCKIPLELWTR

SEQ ID NO: 300
AIEKVTGALKINNLRLVTLEHQVLVIGLKVEAIEKFRYT

AFAMQELGCNQNQFFCKIPLELWTR

SEQ ID NO: 301
AIEKVTGALKINNLRLVTLEHQVLVIGLKVEAMEKFRY

TAFAMQELGCNQNQFFCKIPLELWTR

SEQ ID NO: 302
AIEKVTGALKINNLRLVTLEHQVLVIGLKVEATEKFRYT

AFAMQELGCNQNQFFCKIPLELWTR

SEQ ID NO: 303
AIEKVTGALKINNLRLVTLEHQVLVIGLKVEALEKFRYT

AFAMQELGCNQNQFFCKIPLELWTR

SEQ ID NO: 304
AIEKVTGALKINNLRLVTLEHQVLVIGLKVEAIEKFAYT

AFAMQELGCNQNQFFCKIPLELWTR

SEQ ID NO: 305
AIEKVTGALKINNLRLVTLEHQVLVIGLKVEAMEKFAY

TAFAMQELGCNQNQFFCKIPLELWTR

SEQ ID NO: 306
AIEKVTGALKINNLRLVTLEHQVLVIGLKVEATEKFAYT

AFAMQELGCNQNQFFCKIPLELWTR

SEQ ID NO: 307
AIEKVTGALKINNLRLVTLEHQVLVIGLKVEALEKFAYT

AFAMQELGCNQNQFFCKIPLELWTR

SEQ ID NO: 308
AIEKVTGALKINNLRLVTLEHQVLVIGLKVEAIEKFFYT

AFAMQELGCNQNQFFCKIPLELWTR

SEQ ID NO: 309
AIEKVTGALKINNLRLVTLEHQVLVIGLKVEAMEKFFY

TAFAMQELGCNQNQFFCKIPLELWTR

SEQ ID NO: 310
AIEKVTGALKINNLRLVTLEHQVLVIGLKVEATEKFFYT

AFAMQELGCNQNQFFCKIPLELWTR

SEQ ID NO: 311
AIEKVTGALKINNLRLVTLEHQVLVIGLKVEALEKFFYT

AFAMQELGCNQNQFFCKIPLELWTR

SEQ ID NO: 312
AIEKVTGALKINNLRLVTLEHQVLVIGLKVEAIEKFGYT

AFAMQELGCNQNQFFCKIPLELWTR

SEQ ID NO: 313
AIEKVTGALKINNLRLVTLEHQVLVIGLKVEAMEKFGY

TAFAMQELGCNQNQFFCKIPLELWTR

SEQ ID NO: 314
AIEKVTGALKINNLRLVTLEHQVLVIGLKVEATEKFGYT

AFAMQELGCNQNQFFCKIPLELWTR

SEQ ID NO: 315
AIEKVTGALKINNLRLVTLEHQVLVIGLKVEALEKFGYT

AFAMQELGCNQNQFFCKIPLELWTR
```

As mentioned above, the previous ENV proteins having their ISU comprising the above sequence have decreased immunosuppressive properties, substantially no immunosuppressive properties or no immunosuppressive properties.

Thus, in other words, any feline lentiviral Env protein having in their ISU an amino acid sequence comprising the sequences SEQ ID NO: 28 to 315, have decreased immunosuppressive properties, substantially no immunosuppressive properties or no immunosuppressive properties.

In other words, a feline lentiviral ENV protein comprising, within its ISU domain, an amino acid sequence selected from SEQ ID NO: 28 to 315 have decreased immunosuppressive properties, substantially no immunosuppressive properties or no immunosuppressive properties.

In the invention, the fragments of the mutated ENV proteins according to the invention have decreased immunosuppressive properties, substantially no immunosuppressive properties or no immunosuppressive properties.

However, these fragments retain the structure and the antigenicity of the corresponding immunosuppressive domain that is not mutated, i.e. the wild type immunosuppressive domain.

In another embodiment, the invention relates to a pharmaceutical composition as defined above, wherein mutated feline lentiviral ENV protein or fragment thereof further comprises an additional mutation of one at least of the amino acids $X_1^*$, $X_2^*$, $X_3^*$, $X_4^*$ and $X_5^*$ in the following sequence:

$$\text{(SEQ ID NO: 316)}$$
$$X_1^*\text{-}X_2^*\text{-}X_3^*\text{-}X_4^*\text{-}X_5^*\text{-}[V/I]\text{-}[E/R]\text{-}A\text{-}[I/M/T/L]\text{-}X_1\text{-}X_2\text{-}X_3\text{-}X_4\text{-}X_5\text{-}T\text{-}A$$

wherein $X_1$, $X_2$, $X_3$, $X_4$, $X_5$ are defined as above, and $X_1^*$ is either deleted, or is A, C, D, E, F, G, H, I, K, L, N, P, Q, R, S, Y or W, in particular A, F, G, L or R, and/or $X_2^*$ is either deleted, or is A, C, D, E, F, G, H, K, M, N, P, Q, R, S, T, V, Y or W, in particular A, F, G, or R, and/or $X_3^*$ is either deleted, or is A, C, D, E, F, L, H, I, K, M, N, P, Q, R, S, T, V, Y or W, in particular A, F, L or R, and/or $X_4^*$ is either deleted, or is A, C, D, E, F, G, H, I, K, M, N, P, Q, R, S, T, V, Y or W, in particular A, F, G, or R, and/or $X_5^*$ is either deleted, or is A, C, D, E, F, G, L, H, I, M, N, P, Q, S, V, Y or W, in particular A, F, G or L, in association with a pharmaceutically acceptable carrier.

In such a pharmaceutical composition, the mutated feline lentiviral ENV protein, or fragment thereof, comprises a mutation of one at least of the amino acids $X_1$, $X_2$, $X_3$, $X_4$ and $X_5$ in association with an additional mutation of one at least of the amino acids $X_1^*$, $X_2^*$, $X_3^*$, $X_4^*$ and $X_5^*$.

In the invention, "a mutation of one at least of the amino acids $X_1^*$, $X_2^*$, $X_3^*$, $X_4^*$ and $X_5^*$" means that said mutated acids are:

$X_1^*$ or $X_2^*$ or $X_3^*$ or $X_4^*$ or $X_5^*$ or $X_1^*/X_2^*$ or $X_1^*/X_3^*$ or $X_1^*/X_4^*$ or $X_1^*/X_5^*$ or $X_2^*/X_3^*$ or $X_2^*/X_4^*$ or $X_2^*/X_5^*$ or $X_3^*/X_4^*$ or $X_3^*/X_5^*$ or $X_4^*/X_5^*$ or $X_1^*/X_2^*/X_3^*$ or $X_1^*/X_2^*/X_4^*$ or $X_1^*/X_2^*/X_5^*$ or $X_1^*/X_3^*/X_4^*$ or $X_1^*/X_3^*/X_5^*$ or $X_1^*/X_4^*/X_5^*$ or $X_2^*/X_3^*/X_4^*$ or $X_2^*/X_3^*/X_5^*$ or $X_2^*/X_4^*/X_5^*$ or $X_3^*/X_4^*/X_5^*$ or $X_1^*/X_2^*/X_3^*/X_4^*$ or $X_1^*/X_2^*/X_3^*/X_5^*$ or $X_1^*/X_2^*/X_4^*/X_5^*$ or $X_1^*/X_3^*/X_4^*/X_5^*$ or $X_2^*/X_3^*/X_4^*/X_5^*$ or $X_1^*/X_2^*/X_3^*/X_4^*/X_5^*$.

In another embodiment, the invention relates to a pharmaceutical composition as defined above, wherein mutated feline lentiviral ENV protein or fragment thereof further comprises an additional mutation of the amino acids $X_3^*$ in the following sequence:

(SEQ ID NO: 434)
[T/V/M]-[L/I]-$X_3^*$-L-[K/T/R]-[V/I]-[E/R]-A-

[I/M/T/L]-$X_1$-$X_2$-$X_3$-$X_4$-$X_5$-T-A wherein $X_1$, $X_2$, $X_3$, $X_4$, $X_5$ are defined as above, and $X_3^*$ is either deleted, or is A, C, D, E, F, L, H, I, K, M, N, P, Q, R, S, T, V, Y or W, in particular A, F, L or R, in association with a pharmaceutically acceptable carrier.

In such a pharmaceutical composition, the mutated feline lentiviral ENV protein, or fragment thereof, comprises a mutation of one at least of the amino acids $X_1$, $X_2$, $X_3$, $X_4$ and $X_5$ in association with an additional mutation of $X_3^*$.

The sequences SEQ ID NO: 316 and SEQ ID NO: 434 contain the following amino acid sequence A[I/M/T/L] $X_1X_2X_3X_4X_5$TA (SEQ ID NO: 1) elongated on its N-terminal end, in which an additional mutation is present.

In another aspect, the invention relates to a pharmaceutical composition comprising as active substance an isolated mutated feline lentiviral ENV protein having substantially no immunosuppressive activity, or a fragment thereof, said mutated feline lentiviral ENV protein resulting from mutation of the transmembrane (TM) subunit of a wild type feline lentiviral ENV protein, said mutated feline lentiviral ENV protein or fragment thereof comprising a mutated immunosuppressive domain (ISU) containing the following amino acid sequence:

(SEQ ID NO: 467)
$X_1^*X_2^*$-$X_3^*$-$X_4^*$-$X_5^*$-[V/I]-[E/R]-A-[I/M/T/L]-E-K-

[F/P]-[L/V/I]-Y-T-A wherein $X_1^*$ is either deleted, or is A, C, D, E, F, G, H, I, K, L, N, P, Q, R, S, T V Y or W, in particular A, F, G, L or R, and/or $X_2^*$ is either deleted, or is A, C, D, E, F, G, H, K, M, N, P, Q, R, S, T, V, Y or W, in particular A, F, G or R, and/or $X_3^*$ is either deleted, or is A, C, D, E, F, L, H, I, K, M, N, P, Q, R, S, T, V, Y or W, in particular A, F, L or R, and/or $X_4^*$ is either deleted, or is A, C, D, E, F, G, H, I, K, M, N, P, Q, R, S, T, V, Y or W, in particular A, F, G, or R, and/or $X_5^*$ is either deleted, or is A, C, D, E, F, G, L, H, I, M, N, P, Q, S, V, Y or W, in particular A, F, G, or L.

in association with a pharmaceutically acceptable carrier.

In another aspect, the invention relates to a pharmaceutical composition comprising as active substance an isolated mutated feline lentiviral ENV protein having substantially no immunosuppressive activity, or a fragment thereof, said mutated feline lentiviral ENV protein resulting from mutation of the transmembrane (TM) subunit of a wild type feline lentiviral ENV protein, said mutated feline lentiviral ENV protein or fragment thereof comprising a mutated immunosuppressive domain (ISU) containing the following amino acid sequence:

(SEQ ID NO: 468)
[T/V/M]-[L/I]-$X_3^*$-L-[K/T/R]-[V/I]-[E/R]-A-

[I/M/T/L]-E-K-[F/P]-[L/V/I]-Y-T-A wherein $X_3^*$ is either deleted, or is A, C, D, E, F, L, H, I, K, M, N, P, Q, R, S, T, V, Y or W, in particular A, F, L or R, in association with a pharmaceutically acceptable carrier.

In another advantageous embodiment, the invention relates to a pharmaceutical composition as defined above, wherein said mutated feline lentiviral protein, said variant or said fragment harbour a three-dimensional structure similar to the structure of the natural non mutated feline lentiviral ENV protein, non mutated variant or non fragment thereof.

The skilled person knows how to measure the antigenicity, by using standard proceedings.

In another advantageous embodiment, the invention relates to a pharmaceutical composition as defined above, wherein said mutated feline lentiviral protein or said fragment thereof are expressed at the plasma membrane at a level substantially identical to the expression at the plasma membrane of the natural non mutated lentiviral ENV protein or non mutated fragment thereof.

The membrane expression of the lentiviral ENV protein according to the invention can be measured by any techniques allowing determination of a plasma membrane protein. For instance, cells can be transfected with an expression vector allowing the expression of the mutated lentiviral ENV protein according to the invention. Cells are then incubated with an antibody recognizing specifically the extracellular part of said lentiviral mutated ENV protein. The complex (antibody/ENV protein) is detected by another antibody, and the complex can be quantified by flow cytometry (see examples).

If no complex is detected, the mutated ENV protein is not expressed at the plasma membrane. On the contrary, if the complex is detected, this means that the mutated ENV protein is expressed at the plasma membrane and in an appropriate conformation so as to be detected by the antibody recognizing the extracellular part of the protein.

In another advantageous embodiment, the invention relates to a pharmaceutical composition as defined above, wherein said mutated feline lentiviral ENV protein is such that it has conserved, totally or partially, its fusogenic activity, which is responsible for virus-cell or cell-cell membrane fusion and can be measured by appropriate assays.

In another embodiment, the invention relates to a pharmaceutical composition as defined above, wherein said isolated mutated feline lentiviral ENV protein consists of one of the amino acid sequences: SEQ ID NO: 5 and SEQ ID NO: 317 to 342 and 374 to 419.

```
                                          SEQ ID NO: 317
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMEKGLYTAFAMQELGCNQNQFFC

KIPLELWTRYNMTINQTIWNHGNITLGEWYNQTKDLQQK

FYEIIMDIEQNNVQGKTGIQQLQKWEDWVRWIGNIPQYL

KGLLGGILGIGLGVLLLILCLPTLVDCIRNCIHKILGYTVIA

MPEVEGEEIQPQMELRRNGRQCGMSEKEEE

SEQ ID NO: 318
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMEKLLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 319
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAPP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMEKALYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 320
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV
```

-continued
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKRYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE SEQ ID NO: 321
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKGYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE SEQ ID NO: 322
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKAYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE SEQ ID NO: 323
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFFYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK -continued

GLLGGILGIGLGVLLLILCLPTLVDCIRNCIHKILGYTVIAM

PEVEGEEIQPQMELRRNGRQCGMSEKEEE

SEQ ID NO: 324
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMRKFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 325
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMGKFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 326
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMLKFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 327
MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMAKFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 328

MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMFKFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 329

MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMRFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 330

MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL

RHDIDIEAPQEECYNNREKGTTDNIKYGRRCCLGTVTLYLI

LFTGVIVYSQTAGAQVVWRLPPLVVPVEESEIIFWDCWAP

EEPACQDFLGAMIHLKAKTNISIREGPTLGNWAREIWATL

FKKATRQCRRGRIWKRWNETITGPSGCANNTCYNVSVIV

PDYQCYLDRVDTWLQGKINISLCLTGGKMLYNKVTKQLS

YCTDPLQIPLINYTFGPNQTCMWNTSQIQDPEIPKCGWWN

QMAYYNSCKWEEAKVKFHCQRTQSQPGSWFRAISSWKQ

RNRWEWRPDFKSKKVKISLPCNSTKNLTFAMRSSGDYGE

VTGAWIEFGCHRNKSNLHTEARFRIRCRWNVGSDTSLIDT

CGNTPNVSGANPVDCTMYSNKMYNCSLQNGFTMKVDDL

IVHFNMTKAVEMYNIAGNWSCTSDLPSSWGYMNCNCTN

SSSSYSGTKMACPSNRGILRNWYNPVAGLRQSLEQYQVV

KQPDYLLVPEEVMEYKPRRKRAAIHVMLALATVLSIAGA

GTGATAIGMVTQYHQVLATHQEAIEKVTGALKINNLRLV

TLEHQVLVIGLKVEAMEGFLYTAFAMQELGCNQNQFFCK

IPLELWTRYNMTINQTIWNHGNITLGEWYNQTKDLQQKF

YEIIMDIEQNNVQGKTGIQQLQKWEDWVRWIGNIPQYLK

GLLGGILGIGLGVLLLILCLPTLVDCIRNCIHKILGYTVIAM

PEVEGEEIQPQMELRRNGRQCGMSEKEEE

SEQ ID NO: 331

MAEGFAANRQWIGPEEAEELLDFDIATQMSEEGPLNPGV

NPFRVPGITEKEKQNYCNILQPKLQDLRNEIQEVKLEEGN

AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMELFLYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 332
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEAFLYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 333
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEFFLYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 334
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV

KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFLRTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 335
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFLGTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 336
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFLLTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 337
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFLATAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE

SEQ ID NO: 338
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL

```
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKFLFTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEEE
```

SEQ ID NO: 339

```
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKRRYTAFAMQELGCNQNQFFC
KIPLELWTRYNMTINQTIWNHGNITLGEWYNQTKDLQQK
FYEIIMDIEQNNVQGKTGIQQLQKWEDWVRWIGNIPQYL
KGLLGGILGIGLGVLLLILCLPTLVDCIRNCIHKILGYTVIA
MPEVEGEEIQPQMELRRNGRQCGMSEKEEE
```

SEQ ID NO: 340

```
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKRGYTAFAMQELGCNQNQFFC
KIPLELWTRYNMTINQTIWNHGNITLGEWYNQTKDLQQK
FYEIIMDIEQNNVQGKTGIQQLQKWEDWVRWIGNIPQYL
KGLLGGILGIGLGVLLLILCLPTLVDCIRNCIHKILGYTVIA
MPEVEGEEIQPQMELRRNGRQCGMSEKEEE
```

SEQ ID NO: 341

```
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKRAAIHVMLALATVLSIAGA
GTGATAIGMVTQYHQVLATHQEAIEKVTGALKINNLRLV
TLEHQVLVIGLKVEAMEKRAYTAFAMQELGCNQNQFFC
KIPLELWTRYNMTINQTIWNHGNITLGEWYNQTKDLQQK
FYEIIMDIEQNNVQGKTGIQQLQKWEDWVRWIGNIPQYL
```

```
KGLLGGILGIGLGVLLLILCLPTLVDCIRNCIHKILGYTVIA
MPEVEGEEIQPQMELRRNGRQCGMSEKEEE
```

SEQ ID NO: 342
```
MAEGFAANRQWIGPEEAEELLDFDIATQMSEEGPLNPGV
NPFRVPGITEKEKQNYCNILQPKLQDLRNEIQEVKLEEGN
AGKFRRARFLRYSDERVLSLVHAFIGYCIYLGNRNKLGSL
RHDIDIEAPQEECYNNREKGTTDNIKYGRRCCLGTVTLYLI
LFTGVIVYSQTAGAQVVWRLPPLVVPVEESEIIFWDCWAP
EEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNSCKWEEAKVKFHCQRTQSQPGSWFRAISSWKQ
RNRWEWRPDFKSKKVKISLPCNSTKNLTFAMRSSGDYGE
VTGAWIEFGCHRNKSNLHTEARFRIRCRWNVGSDTSLIDT
CGNTPNVSGANPVDCTMYSNKMYNCSLQNGFTMKVDDL
IVHFNMTKAVEMYNIAGNWSCTSDLPSSWGYMNCNCTN
SSSSYSGTKMACPSNRGILRNWYNPVAGLRQSLEQYQVV
KQPDYLLVPEEVMEYKPRRKAAIHVMLALATVLSIAGA
GTGATAIGMVTQYHQVLATHQEAIEKVTGALKINNLRLV
TLEHQVLVIGLKVEAMEKRFYTAFAMQELGCNQNQFFCK
IPLELWTRYNMTINQTIWNHGNITLGEWYNQTKDLQQKF
YEIIMDIEQNNVQGKTGIQQLQKWEDWVRWIGNIPQYLK
GLLGGILGIGLGVLLLILCLPTLVDCIRNCIHKILGYTVIAM
PEVEGEEIQPQMELRRNGRQCGMSEKEE
```

SEQ ID NO: 374
```
MAEGFAANRQWIGLEEAEELLDFDIATQMSEEGPLNPGV
NPFRVPGITEKEKQNYCNILQPKLQDLRNEIQEVKLEEGN
AGKFRRARFLRYSDESVLSLVHAFIGYCIYLGNRNKLGSL
RHDIDIEAPQEECYNNREKGTTDNIKYGRRCCLGTVTLYLI
LFIGIIIYSQTTNAQVVWRLPPLVVPVEESEIIFWDCWAPEE
PACQDFLGAMIHLKAKTNISIREGPTLGNWAREIWATLFK
KATRQCRRGRIWKRWNETITGPSGCANNTCYNVSVIVPD
YQCYLDRVDTWLQGKINISLCLTGGKMLYNKVTKQLSYC
TDPLQIPLINYTFGPNQTCMWNTSQIQDPEIPKCGWWNQM
AYYNSCKWEEAKVKFHCQRTQSQPGSWFRAISSWKQRN
RWEWRPDFESKKVKISLQCNSTKNLTFAMRSSGDYGEVT
GAWIEFGCHRNKSKLHAEARFRIRCRWNVGSNTSLIDTCG
NTQKVSGANPVDCTMYSNKMYNCSLQNGFTMKVDDLIM
HFNMKKAVEMYNIAGNWSCTSDLPSSWGYMNCNCTNSS
SSYSGTKMACPSNRGILRNWYNPVAGLRQSLEQYQVVKQ
PDYLVVPEEVMEYKPRRKAAIHVMLALAAVLSIAGAGT
GATAIGMVTQYHQVLATHQEAVEKVTEALKINNLRLVTL
EHQVLVIGLKVEAMEKRLYTAFAMQELGCNQNQFFCKIP
PELWTRYNMTINQTIWNHGNITLGEWYNQTKDLQQKFYE
IIMDIEQNNVQGKKGIQQLQKWEDWVGWIGNIPQYLKGL
LGGILGIGLGVLLLILCLPTLVDCIRNCIHKILGYTVIAMPE
VEGEEIQPQMELRRNGRQCGMSEKEEE
```

SEQ ID NO: 375
```
MAEGFAANRQWIGLEEAEELLDFDIATQMSEEGPLNPGV
NPFRVPGITEKEKQNYCNILQPKLQDLRNEIQEVKLEEGN
AGKFRRARFLRYSDESVLSLVHAFIGYCIYLGNRNKLGSL
RHDIDIEAPQEECYNNREKGTTDNIKYGRRCCLGTVTLYLI
LFIGIIIYSQTTNAQVVWRLPPLVVPVEESEIIFWDCWAPEE
PACQDFLGAMIHLKAKTNISIREGPTLGNWAREIWATLFK
KATRQCRRGRIWKRWNETITGPSGCANNTCYNVSVIVPD
YQCYLDRVDTWLQGKINISLCLTGGKMLYNKVTKQLSYC
TDPLQIPLINYTFGPNQTCMWNTSQIQDPEIPKCGWWNQM
AYYNSCKWEEAKVKFHCQRTQSQPGSWFRAISSWKQRN
RWEWRPDFESKKVKISLQCNSTKNLTFAMRSSGDYGEVT
GAWIEFGCHRNKSKLHAEARFRIRCRWNVGSNTSLIDTCG
NTQKVSGANPVDCTMYSNKMYNCSLQNGFTMKVDDLIM
HFNMKKAVEMYNIAGNWSCTSDLPSSWGYMNCNCTNSS
SSYSGTKMACPSNRGILRNWYNPVAGLRQSLEQYQVVKQ
PDYLVVPEEVMEYKPRRKAAIHVMLALAAVLSIAGAGT
GATAIGMVTQYHQVLATHQEAVEKVTEALKINNLRLVTL
EHQVLVIGLKVEAMEKRYTAFAMQELGCNQNQFFCKIP
PELWTRYNMTINQTIWNHGNITLGEWYNQTKDLQQKFYE
IIMDIEQNNVQGKKGIQQLQKWEDWVGWIGNIPQYLKGL
LGGILGIGLGVLLLILCLPTLVDCIRNCIHKILGYTVIAMPE
VEGEEIQPQMELRRNGRQCGMSEKEEE
```

SEQ ID NO: 376
```
MAEGFVANGQWIGPEEAEELVDFEIATQMNEEGPLNPGIN
PFRVPGITKQEKQEYCSTMQPKLQALRNEIQEVKLEEGNA
GKFRRARFLRYSDETILSLIYLFIGYFRYLVDRKRFGSLRH
DIDIEAPQEECYNNKEKGMTENIKYGKRCLVGTAALYLIL
AIGIIIIRTTDAQVVWRLPPLVVPVEESEIIFWDCWAPEEPA
CQDFLGAMIHLKASTNISNTEGPTLGNWAREIWATLFKKA
TRQCRRGRIWKRWNETITGPIGCANNTCYNISVIVPDYQC
YIDRVDTWLQGKVNISLCLTGGKMLYNKETKQLSYCTDP
LQIPLINYTFGPNQTCMWNISQIQDPEIPKCGWWNQQAYY
NNCKWERTDVKFQCQRTQSQPGSWIRAISSWKQGNRWE
WRPDFESERVKVSLQCNSTRNLTFAMRSSGDYGEITGAWI
```

EFGCHRNKSIRHNAARFRIRCRWNEGDNNSLIDTCGETQN

VSGANPVDCTMYANKMYNCSLQDGFTMKVDDLIMHFN

MTKAVEMYNIAGNWSCMSDLPTEWGYMNCNCTNDTSN

NNTRKMKCPKENGILRNWYNPVAGLRQSLEKYQVVKQP

DYLLVPEEVMEYKPRRKRAAIHVMLALATVLSMAGAGT

GATAIGMVTQYHQVLATQQEAIEKVTEALKITNLRLVTLE

HQVLVIGLKVEAMEKRLYTAFAMQELGCNQNQFFCKVPP

ELWRRYNMTINQTIWNHGNITLGEWYNQTKDLQKKFYGI

IMDIEQNNVQGKKGLQQLQKWEDVVGWIGNIPQYLKGL

LGSIVGIGLGILLLILCLPTLVDCIRNCIHKILGYTVIAMPEV

DGEEIQPQMELRRNGRQCGMSEKEEE

SEQ ID NO: 377
MAEGFVANGQWIGPEEAEELVDFEIATQMNEEGPLNPGIN

PFRVPGITKQEKQEYCSTMQPKLQALRNEIQEVKLEEGNA

GKFRRARFLRYSDETILSLIYLFIGYFRYLVDRKRFGSLRH

DIDIEAPQEECYNNKEKGMTENIKYGKRCLVGTAALYLIL

AIGIIIIRTTDAQVVWRLPPLVVPVEESEIIFWDCWAPEEPA

CQDFLGAMIHLKASTNISNTEGPTLGNWAREIWATLFKKA

TRQCRRGRIWKRWNETITGPIGCANNTCYNISVIVPDYQC

YIDRVDTWLQGKVNISLCLTGGKMLYNKETKQLSYCTDP

LQIPLINYTFGPNQTCMWNISQIQDPEIPKCGWWNQQAYY

NNCKWERTDVKFQCQRTQSQPGSWIRAISSWKQGNRWE

WRPDFESERVKVSLQCNSTRNLTFAMRSSGDYGEITGAWI

EFGCHRNKSIRHNAARFRIRCRWNEGDNNSLIDTCGETQN

VSGANPVDCTMYANKMYNCSLQDGFTMKVDDLIMHFN

MTKAVEMYNIAGNWSCMSDLPTEWGYMNCNCTNDTSN

NNTRKMKCPKENGILRNWYNPVAGLRQSLEKYQVVKQP

DYLLVPEEVMEYKPRRKRAAIHVMLALATVLSMAGAGT

GATAIGMVTQYHQVLATQQEAIEKVTEALKITNLRLVTLE

HQVLVIGLKVEAMEKFRYTAFAMQELGCNQNQFFCKVPP

ELWRRYNMTINQTIWNHGNITLGEWYNQTKDLQKKFYGI

IMDIEQNNVQGKKGLQQLQKWEDVVGWIGNIPQYLKGL

LGSIVGIGLGILLLILCLPTLVDCIRNCIHKILGYTVIAMPEV

DGEEIQPQMELRRNGRQCGMSEKEEE

SEQ ID NO: 378
MAEGFVANGQWIGPEEAEELLDFDIATQLNEEGPLNPGIN

PFRVPGITQKEKQEYCNTLQPKLQALRNEIQEVKLEERNA

GKFRRARFLRYSDETILSLIYSFVGYFRYLVDRKKFGSLRH

DIDIEAPQEEYYNNKEKGMTDNVKYGKRCLVGTAAFYLL

LAIGIIIIRTVDAQVVWRLPPLVVPVEESEIIFWDCWAPEEP

ACQDFLGAMIHLKASTNIRIQEGPTLGNWAREIWATLFKK

ATRQCRRGRIWKRWNETITGPIGCANNTCYNISVIIPDYQC

YIDRVDTWLQGKVNISICLTGGKMLYNKETKQLSYCTDP

LQIPLINYTFGPQQTCMWNTSQIQDPEIPKCGWWNQKAY

YNQCSWEQTDVKFQCQRTQSQPGSWIRAISSWRQRNRWE

WRPDFESERVKVSLQCNSTQNLTFAMRSSGDYGEITGAWI

EFGCHRNKSKHHNEARFRIRCRWNEGNNNSLIDTCGKTQ

NVLGANPVDCTMYANRMYNCSLQDGFTMKVDDLIMHF

NMTKAVEMYNIAGNWSCMSDLPTNWGYMKCNCTNDTS

NNHTIKMECPEEKGILRNWYNPVAGLRQSLEKYQVVKQP

DYLVVPGEVMEYKPRRKRAAIHVMLALATVLSMAGAGT

GATAIGMVTQYHQVLATHQEAIEKVTEALKINNLRLVTLE

HQVLVIGLKVEAIEKRLYTAFAMQELGCNQNQFFCKVPL

ELWRRYNMTINQTIWNHGNITLGEWYNQTKALQHKFYEI

IMDIEQNNVQGKKGLQQLQKWEDVVGWIGNIPQYLKGL

LGGILGIGLGILLLILCLPTLVDCIRNCIHKILGYTVIAMPDV

DEEEIQPQMELRRNGRQCGMSEKEEE

SEQ ID NO: 379
MAEGFVANGQWIGPEEAEELLDFDIATQLNEEGPLNPGIN

PFRVPGITQKEKQEYCNTLQPKLQALRNEIQEVKLEERNA

GKFRRARFLRYSDETILSLIYSFVGYFRYLVDRKKFGSLRH

DIDIEAPQEEYYNNKEKGMTDNVKYGKRCLVGTAAFYLL

LAIGIIIIRTVDAQVVWRLPPLVVPVEESEIIFWDCWAPEEP

ACQDFLGAMIHLKASTNIRIQEGPTLGNWAREIWATLFKK

ATRQCRRGRIWKRWNETITGPIGCANNTCYNISVIIPDYQC

YIDRVDTWLQGKVNISICLTGGKMLYNKETKQLSYCTDP

LQIPLINYTFGPQQTCMWNTSQIQDPEIPKCGWWNQKAY

YNQCSWEQTDVKFQCQRTQSQPGSWIRAISSWRQRNRWE

WRPDFESERVKVSLQCNSTQNLTFAMRSSGDYGEITGAWI

EFGCHRNKSKHHNEARFRIRCRWNEGNNNSLIDTCGKTQ

NVLGANPVDCTMYANRMYNCSLQDGFTMKVDDLIMHF

NMTKAVEMYNIAGNWSCMSDLPTNWGYMKCNCTNDTS

NNHTIKMECPEEKGILRNWYNPVAGLRQSLEKYQVVKQP

DYLVVPGEVMEYKPRRKRAAIHVMLALATVLSMAGAGT

GATAIGMVTQYHQVLATHQEAIEKVTEALKINNLRLVTLE

HQVLVIGLKVEAIEKFRYTAFAMQELGCNQNQFFCKVPL

ELWRRYNMTINQTIWNHGNITLGEWYNQTKALQHKFYEI

IMDIEQNNVQGKKGLQQLQKWEDVVGWIGNIPQYLKGL

LGGILGIGLGILLLILCLPTLVDCIRNCIHKILGYTVIAMPDV

DEEEIQPQMELRRNGRQCGMSEKEEE

SEQ ID NO: 380
MAEGFAANRQWIGPEEAEELLDFDIAIQMNEEGPLNPGVN

PFRVPGITEAEKQEYCNILQPKLQDLKGKIQEVKLEEGNA

```
GKFRRARFLRYSDETVLSLIHLFIGYCPHLCRRHELGSLRH
DIDIEALQEERYNDREKGITDNIKYGKRCLIGTAVLYLLLS
LGIIIHTCKAQVVWRLPPLVVPVEESEIIFWDCWAPEEPAC
QDFLGAMIHLKASTNISIQEGPTLGNWAREIWGTLFKKAT
RQCRRGRIWRRWNETITGPLGCANNTCYNISVIVPDYQCY
LDRVDTWLQGKVNISLCLTGGKMLYNKETKQLSYCTDPL
QIPLINYTFGPNQTCMWNTSQIQDPEIPKCGWWNQNAYY
NSCRWEHTDVQFQCQRTQSQPGSWIRAISSWKQRNRWE
WRPDFESEKVKVSLQCNSTKNLTFAMRSSGDYGEVTGA
WIEFGCHRTKSKYHTEARFRIRCRWNVGDNTSLIDTCGET
QNVSRANPVDCTMYANRMYNCSLQNGFTMKVDDLIMHF
NKTKAVEMYNIAGNWSCKSDLPPTWGYMNCNCTNSTNS
GTGIRMACPRNQGILRNWYNPVAGLRQSLEKYQVVKQPD
YLVVPGEVMEYKPRRKRAAIHVMLALATVLSMAGAGTG
ATAIGMVTQYQQVLATHQEAIEKVTEALKINNLRLVTLEH
QVLVIGLKVEAMEKRLYTAFAMQELGCNQNQFFCKVPSA
LWERYNMTINQTIWNHGNITLGEWYNQTKDLQQRFYEII
MDIEQNNVQGKKGLQQLQEWEDWVGWIGNIPQYLKGLL
GGILGIGLGMLLLILCLPTLVDCIRNCIHKILGYTVIAMPEV
EEEEIQPQMELRRNGRQCGMSEKEEE

SEQ ID NO: 381
MAEGFAANRQWIGPEEAEELLDFDIAIQMNEEGPLNPGVN
PFRVPGITEAEKQEYCNILQPKLQDLKGKIQEVKLEEGNA
GKFRRARFLRYSDETVLSLIHLFIGYCPHLCRRHELGSLRH
DIDIEALQEERYNDREKGITDNIKYGKRCLIGTAVLYLLLS
LGIIIHTCKAQVVWRLPPLVVPVEESEIIFWDCWAPEEPAC
QDFLGAMIHLKASTNISIQEGPTLGNWAREIWGTLFKKAT
RQCRRGRIWRRWNETITGPLGCANNTCYNISVIVPDYQCY
LDRVDTWLQGKVNISLCLTGGKMLYNKETKQLSYCTDPL
QIPLINYTFGPNQTCMWNTSQIQDPEIPKCGWWNQNAYY
NSCRWEHTDVQFQCQRTQSQPGSWIRAISSWKQRNRWE
WRPDFESEKVKVSLQCNSTKNLTFAMRSSGDYGEVTGA
WIEFGCHRTKSKYHTEARFRIRCRWNVGDNTSLIDTCGET
QNVSRANPVDCTMYANRMYNCSLQNGFTMKVDDLIMHF
NKTKAVEMYNIAGNWSCKSDLPPTWGYMNCNCTNSTNS
GTGIRMACPRNQGILRNWYNPVAGLRQSLEKYQVVKQPD
YLVVPGEVMEYKPRRKRAAIHVMLALATVLSMAGAGTG
ATAIGMVTQYQQVLATHQEAIEKVTEALKINNLRLVTLEH
QVLVIGLKVEAMEKFRYTAFAMQELGCNQNQFFCKVPSA
LWERYNMTINQTIWNHGNITLGEWYNQTKDLQQRFYEII
MDIEQNNVQGKKGLQQLQEWEDWVGWIGNIPQYLKGLL
GGILGIGLGMLLLILCLPTLVDCIRNCIHKILGYTVIAMPEV
EEEEIQPQMELRRNGRQCGMSEKEEE

SEQ ID NO: 382
MAEGFAANRQWIGPEEAEELLDFDIATQMSEEGPLNPGV
NPFRVPGITEKEKQNYCNILQPKLQDLRDEIQEVKLEEGN
AGKFRRTRFLRYSDEHVLSLVHAFIGYCIYLGNRNKLGSL
RHDIDIEAPQEEYYNNREKGTTDNIKYGRRCCLGTVTLYL
ILFIGVIVYSQTAGAQVVWRLPPLVVPVEESEIIFWDCWAP
DEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNRCKWEEAKVKFHCQRTQSQPGSWRRAISSWKQ
RNRWEWRPDLESEKVKISLQCNSKKNLTFAMRSSGDYGE
VTGAWIEFGCHRNKSKHHSEARFRIRCRWNVGSNTSLIDT
CGNTQDVSGANPVDCTMYSNKMYNCSLQNGFTMKVDD
LIVHFSMTKAVKMYNIAGNWSCTSDLPSSWGYMNCNCT
NSSSSYSGTKMACPSNRGILRNWYNPVAGLRQSLEQYQV
VKQPDYLVVPEEVMEYKPRRKRAAIHVMLALATVLSIAG
AGTGATAIGMVTQYHQVLATHQEAIEKVTEALKINNLRL
VTLEHQVLVIGLKVEAMEKRLYTAFAMQELGCNQNQFFC
KIPPGLWTRYNMTINQTIWNHGNITLGEWYNKTKDLQQK
FYEIIMDIEQNNVQGKTGIQQLQKWEDWVGWIGNIPQYL
KGLLGGILGIGLGVLLLILCLPTLVDCIRNCIHKILGYTVIA
MPEVEGEEIQPQMELRRNGRQCGMSEKEEE

SEQ ID NO: 383
MAEGFAANRQWIGPEEAEELLDFDIATQMSEEGPLNPGV
NPFRVPGITEKEKQNYCNILQPKLQDLRDEIQEVKLEEGN
AGKFRRTRFLRYSDEHVLSLVHAFIGYCIYLGNRNKLGSL
RHDIDIEAPQEEYYNNREKGTTDNIKYGRRCCLGTVTLYL
ILFIGVIVYSQTAGAQVVWRLPPLVVPVEESEIIFWDCWAP
DEPACQDFLGAMIHLKAKTNISIREGPTLGNWAREIWATL
FKKATRQCRRGRIWKRWNETITGPSGCANNTCYNVSVIV
PDYQCYLDRVDTWLQGKINISLCLTGGKMLYNKVTKQLS
YCTDPLQIPLINYTFGPNQTCMWNTSQIQDPEIPKCGWWN
QMAYYNRCKWEEAKVKFHCQRTQSQPGSWRRAISSWKQ
RNRWEWRPDLESEKVKISLQCNSKKNLTFAMRSSGDYGE
VTGAWIEFGCHRNKSKHHSEARFRIRCRWNVGSNTSLIDT
CGNTQDVSGANPVDCTMYSNKMYNCSLQNGFTMKVDD
LIVHFSMTKAVKMYNIAGNWSCTSDLPSSWGYMNCNCT
NSSSSYSGTKMACPSNRGILRNWYNPVAGLRQSLEQYQV
```

```
VKQPDYLVVPEEVMEYKPRRKRAAIHVMLALATVLSIAG
AGTGATAIGMVTQYHQVLATHQEAIEKVTEALKINNLRL
VTLEHQVLVIGLKVEAMEKRYTAFAMQELGCNQNQFFC
KIPPGLWTRYNMTINQTIWNHGNITLGEWYNKTKDLQQK
FYEIIMDIEQNNVQGKTGIQQLQKWEDWVGWIGNIPQYL
KGLLGGILGIGLGVLLLILCLPTLVDCIRNCIHKILGYTVIA
MPEVEGEEIQPQMELRRNGRQCGMSEKEEE
```

SEQ ID NO: 384
```
MAKGFAANRQWIGPEEAEELLDFDIATQMNEEGPLNPGV
NPFRVPGITEQEKQDYCNILQPKLQELRNEIQEVKLEEGNA
GKFRRARFLRYSDETILSLIHLFIGYCTYLCKRNELGSLRH
DIDIEAPQEECYNNKEKGTTNNIKYGGRCFIGTMIMYLLIFI
GIIIYIQTTEAQVVWRLPPLIVPVKESEIIFWDCWAPEEPAC
QDFLGAMIHLKASTNISIQEGPTLGNWAREIWGTLFKKAT
RQCRRGRIWKRWNETITGPLGCANNTCYNISVIVPDYQCY
LDRVDTWLQGKVNISLCLTGGKMLYNKDTKQLSYCTDPL
QIPLINYTFGPNQTCMWNTSQIQDPEIPKCGWWNQIAYYN
SCKWEKTDVKFHCQRTQSQPGSWIRAISSWRQRNRWEW
RPDFESEKVKVSLQCNSTKNLTFAMRSSGDYGEVTGAWI
EFGCHRKKSKLHTEARFRIRCRWNVGNNASLIDTCGNTPD
VSGANPVNCTMYANKMYNCWLQNGFTIKVDDLIMHFN
MTKAVEMYNIAGNWSCTSDLPPTWGYMKCNCTNNSDDT
RGKMACPRTQGILRNWYNPVAGLRQSLEKYQVVKQPDY
LVVPGEVMEYKPRRKRAAIHVMLALATVLSMAGAGTGA
TAIGMVTQYHQVLATHQEAIEKVTEALKINNLRLVTLEHQ
VLVIGLKVEAMEKRLYTAFAMQELGCNQNQFFCKVPPQL
WKRYNMTINQTIWNHGNITLGEWYNQTKDLQQKFYEIIM
DIEQNNVQGKTGIQQLQRWEDWVGWIGNIPQYLKGLLGG
ILGIGLGVLLLILCLPTLVDCIRNCIHKILGYTVIAMPEVEEE
EIQQQMELRRNGRQCGMSEKEEE
```

SEQ ID NO: 385
```
MAKGFAANRQWIGPEEAEELLDFDIATQMNEEGPLNPGV
NPFRVPGITEQEKQDYCNILQPKLQELRNEIQEVKLEEGNA
GKFRRARFLRYSDETILSLIHLFIGYCTYLCKRNELGSLRH
DIDIEAPQEECYNNKEKGTTNNIKYGGRCFIGTMIMYLLIFI
GIIIYIQTTEAQVVWRLPPLIVPVKESEIIFWDCWAPEEPAC
QDFLGAMIHLKASTNISIQEGPTLGNWAREIWGTLFKKAT
RQCRRGRIWKRWNETITGPLGCANNTCYNISVIVPDYQCY
LDRVDTWLQGKVNISLCLTGGKMLYNKDTKQLSYCTDPL
QIPLINYTFGPNQTCMWNTSQIQDPEIPKCGWWNQIAYYN
SCKWEKTDVKFHCQRTQSQPGSWIRAISSWRQRNRWEW
RPDFESEKVKVSLQCNSTKNLTFAMRSSGDYGEVTGAWI
EFGCHRKKSKLHTEARFRIRCRWNVGNNASLIDTCGNTPD
VSGANPVNCTMYANKMYNCWLQNGFTIKVDDLIMHFN
MTKAVEMYNIAGNWSCTSDLPPTWGYMKCNCTNNSDDT
RGKMACPRTQGILRNWYNPVAGLRQSLEKYQVVKQPDY
LVVPGEVMEYKPRRKRAAIHVMLALATVLSMAGAGTGA
TAIGMVTQYHQVLATHQEAIEKVTEALKINNLRLVTLEHQ
VLVIGLKVEAMEKRYTAFAMQELGCNQNQFFCKVPPQL
WKRYNMTINQTIWNHGNITLGEWYNQTKDLQQKFYEIIM
DIEQNNVQGKTGIQQLQRWEDWVGWIGNIPQYLKGLLGG
ILGIGLGVLLLILCLPTLVDCIRNCIHKILGYTVIAMPEVEEE
EIQQQMELRRNGRQCGMSEKEEE
```

SEQ ID NO: 386
```
MAEGFAANRQWIGPEEAEELLDFDIATQMNEEGPLNPGIN
PFRVPGITEIEKQAYCKILQPRLQALRNEIQEVKLEEGNAG
KFRRARFLRYSDVAILSLIHVFIGYCTYLCNQQKLGSLRHD
IDIEAPQEEYYSNNEKGTTDNIKYGRRCVIGTVALYLLICT
GIIIYTRTATAQVVWRLPPLVVPVEESEVIFWDCWAPEEPA
CQDFLGAMIHLKASTNISIQEGPTLGNWAREIWGTLFKKA
TRQCRRGRIWRRWNETITGPLGCANNTCYNISVIVPDYQC
YLDRVDTWLQGKINISLCLTGGKMLYNRYTKQLSYCTDP
LQIPLINYTFGPNQTCMWNTSQIQDPEIPKCGWWNQRAY
YNSCRWESTDVKFHCQRTQSQPGSWLRAISSWRQRNRW
EWRPDFESEKVKVSLQCNSTKNLTFAMRSSGDYGDVTGA
WIEFGCHRNKSRLHTEARFRIRCRWNVGDNTSLIDTCGKT
QNIAGANPVDCTMYVNRMYNCSLQNGFTMKVDDLIMHF
NMTKAVEMYNIAGNWSCTSNLPPTWGYINCNCTNSSDSN
KMACPSSQGILRNWYNPVAGLRQSLEKYQVVKQPDYLV
VPGEVMEYKPRRKRAAIHVMLALATILSMAGAGTGATAI
GMVTQYHQVLATHQEAIEKVTEALKVNNLRLITLEHQVL
VIGLKVEAMEKRLYTAFAMQELGCNQNQFFCKVPPELW
KRYNMTINQTIWNHGNITLGEWYNQTKGLQQKFYEIMDI
EQNSVQGKKGIQQLQEWEDWIGWIGNIPQYLKGLLGGIL
GIGLGVLLLILCLPTLVDCIRNCIHKILGYTVIAMPEVEGEE
IQPQMELRRNGRQCGMSEKEEE
```

SEQ ID NO: 387
```
MAEGFAANRQWIGPEEAEELLDFDIATQMNEEGPLNPGIN
PFRVPGITEIEKQAYCKILQPRLQALRNEIQEVKLEEGNAG
KFRRARFLRYSDVAILSLIHVFIGYCTYLCNQQKLGSLRHD
IDIEAPQEEYYSNNEKGTTDNIKYGRRCVIGTVALYLLICT
GIIIYTRTATAQVVWRLPPLVVPVEESEVIFWDCWAPEEPA
CQDFLGAMIHLKASTNISIQEGPTLGNWAREIWGTLFKKA
```

-continued

TRQCRRGRIWRRWNETITGPLGCANNTCYNISVIVPDYQC

YLDRVDTWLQGKINISLCLTGGKMLYNRYTKQLSYCTDP

LQIPLINYTFGPNQTCMWNTSQIQDPEIPKCGWWNQRAY

YNSCRWESTDVKFHCQRTQSQPGSWLRAISSWRQRNRW

EWRPDFESEKVKVSLQCNSTKNLTFAMRSSGDYGDVTGA

WIEFGCHRNKSRLHTEARFRIRCRWNVGDNTSLIDTCGKT

QNIAGANPVDCTMYVNRMYNCSLQNGFTMKVDDLIMHF

NMTKAVEMYNIAGNWSCTSNLPPTWGYINCNCTNSSDSN

KMACPSSQGILRNWYNPVAGLRQSLEKYQVVKQPDYLV

VPGEVMEYKPRRKAAIHVMLALATILSMAGAGTGATAI

GMVTQYHQVLATHQEAIEKVTEALKVNNLRLITLEHQVL

VIGLKVEAMEKRYTAFAMQELGCNQNQFFCKVPPELW

KRYNMTINQTIWNHGNITLGEWYNQTKGLQQKFYEIIMDI

EQNSVQGKKGIQQLQEWEDWIGWIGNIPQYLKGLLGGIL

GIGLGVLLLILCLPTLVDCIRNCIHKILGYTVIAMPEVEGEE

IQPQMELRRNGRQCGMSEKEEE

SEQ ID NO: 388
MNEEGPLNPGINPFRVPGITETEKQDYCNMLQPKLQALRN

EIQEVKLEEGNAGKFRRARFLRYSDETILSLIHLFIGYCTYL

LNRKELGSLRHDIDIEAPQEECYSSREQSITDNIKYGKRCFI

GTAGLYLLLFIGVGIYLGTAKAQVVWRLPPLVVPVEESEII

FWDCWAPEEPACQDFLGAMIHLKASTNISIQEGPTLGNW

AKEIWGTLFKKATRQCRRGRIWKRWNETISGPLGCANNT

CYNISVIVPDYQCYLDRVDTWLQGKVNVSLCLTGGKILY

NKYTKQLSYCTDPLQIPLISYTFGPNQTCMWDTSQIQDPEI

PKCGWWNQIAYYNSCRWESTDVKFHCQRTQSQPGLWLR

AISSWKQRNRWEWRPDFESEKAKVSLQCNSTKNLTFAMR

SSGDYGEVTGAWIEFGCHRNKSKLHTEARFRIRCRWNVG

DNTSLIDTCGETQNVSGANPVDCTMYANRMYNCSLQNGF

TMKVDDLIMHFNMTKAVEMYDIAGNWSCTSDLPPTWGY

MNCNCTNSSSTNSVKMACPKNQGILRNWYNPVAGLRQS

LEKYQVVKQPDYLVVPGEVMEYKPRRKAAIHVMLALA

TVLSMAGAGTGATAIGMVTQYHQVLATHQETIEKVTEAL

KINNLRLVTLEHQVLVIGLKVEAMEKRLYTAFAMQELGC

NQNQFFCKVPPELWKRYNMTINQTIWNHGNITLGEWYNQ

TKELQQKFYEIIMNIEQNNVVKKGLQQLQEWEDWVGWI

GNIPQYLKGLLGGILGIGIGVLLLILCLPTLVDCIRNCISKVL

GYTVIAMPEIGDEEETVQMELRKNGRQCGMSEKEEE

SEQ ID NO: 389
MNEEGPLNPGINPFRVPGITETEKQDYCNMLQPKLQALRN

EIQEVKLEEGNAGKFRRARFLRYSDETILSLIHLFIGYCTYL

LNRKELGSLRHDIDIEAPQEECYSSREQSITDNIKYGKRCFI

GTAGLYLLLFIGVGIYLGTAKAQVVWRLPPLVVPVEESEII

FWDCWAPEEPACQDFLGAMIHLKASTNISIQEGPTLGNW

AKEIWGTLFKKATRQCRRGRIWKRWNETISGPLGCANNT

CYNISVIVPDYQCYLDRVDTWLQGKVNVSLCLTGGKILY

NKYTKQLSYCTDPLQIPLISYTFGPNQTCMWDTSQIQDPEI

PKCGWWNQIAYYNSCRWESTDVKFHCQRTQSQPGLWLR

AISSWKQRNRWEWRPDFESEKAKVSLQCNSTKNLTFAMR

SSGDYGEVTGAWIEFGCHRNKSKLHTEARFRIRCRWNVG

DNTSLIDTCGETQNVSGANPVDCTMYANRMYNCSLQNGF

TMKVDDLIMHFNMTKAVEMYDIAGNWSCTSDLPPTWGY

MNCNCTNSSSTNSVKMACPKNQGILRNWYNPVAGLRQS

LEKYQVVKQPDYLVVPGEVMEYKPRRKAAIHVMLALA

TVLSMAGAGTGATAIGMVTQYHQVLATHQETIEKVTEAL

KINNLRLVTLEHQVLVIGLKVEAMEKRLYTAFAMQELGC

NQNQFFCKVPPELWKRYNMTINQTIWNHGNITLGEWYNQ

TKELQQKFYEIIMNIEQNNVVKKGLQQLQEWEDWVGWI

GNIPQYLKGLLGGILGIGIGVLLLILCLPTLVDCIRNCISKVL

GYTVIAMPEIGDEEETVQMELRKNGRQCGMSEKEEE

SEQ ID NO: 390
<SEQ ID NO: 390; PRT; Artificial sequence>

MAEGFAANRQWIGPEEAEELLDFDIATQMNEEGPLNPGIN

PFRVPGITEIEKRDYCKILQPKLQDLKNEIQEVKLEEGNAG

KFRRARFLRYSDENILSLIHLFIGYCTYLCRKNELGSLRHDI

DIDEHQEEYYTNIEKGTTANIKYGRRCLIGTAALYLLFIGIII

YTQTTKAQVVWRLPPFVVPVEESEIIFWDCWAPEEPACQD

FLGAMIHLKASTNISIQEGPTLGNWAREIWGTLFKKATRQ

CRRGRVWRRWNETITGPSGCANNTCYNISVIVPDYQCYL

DRVDTWLQGKVNISLCLTGGKMLYNKYTKQLSYCTDPL

QIPLINYTFGPNQTCMWNTSQIQDPEIPKCGWWNQAAYY

NSCRWESTDVKFHCQRTQSLPGTWLRTISSWRPKNRWEW

RPDFESEKVKVSLQCNSTNNLTFAMRSSGDYGEVTGAWI

EFGCHRKKSKLHSEARFRIRCRWDKGDNTSLIDTCGKTQN

VLGANPVDCTMYANRMYNCSLQNGFTMKIDDLVMHFN

MTKAVEMYNIAGNWSCTSDLPPTWGYMNCNCTNSSSTSS

SSGNKMACPGDKGILRNWYNPVAGLRQSLEKYQVVKQP

DYLVVPGEVMEYKPRRKAAIHVMLALATVLSMAGAGT

GATAIGMVTQYHQVLATHQEAIEKVTEALKINNLRLVTLE

HQVLVIGLKVEAMEKRLYTAFAMQELGCNQNQFFCKVPP

VLWERYNMTINQTIWNHGNITLGEWYNQTKDLQQKFYEI

IMDIEQNNVQGKKGLQQLQKWEDWVGWIGNIPKYLKGL

LGGILGIGLGVILLILCLPTLVDCVRNCIHKILGYTVIAMPE
VEEEEIQPQMELRRNGRQCGISEKEEE

SEQ ID NO: 391
MAEGFAANRQWIGPEEAEELLDFDIATQMNEEGPLNPGIN
PFRVPGITEIEKRDYCKILQPKLQDLKNEIQEVKLEEGNAG
KFRRARFLRYSDENILSLIHLFIGYCTYLCRKNELGSLRHDI
DIDEHQEEYYTNIEKGTTANIKYGRRCLIGTAALYLLFIGIII
YTQTTKAQVVWRLPPFVVPVEESEIIFWDCWAPEEPACQD
FLGAMIHLKASTNISIQEGPTLGNWAREIWGTLFKKATRQ
CRRGRVWRRWNETITGPSGCANNTCYNISVIVPDYQCYL
DRVDTWLQGKVNISLCLTGGKMLYNKYTKQLSYCTDPL
QIPLINYTFGPNQTCMWNTSQIQDPEIPKCGWWNQAAYY
NSCRWESTDVKFHCQRTQSLPGTWLRTISSWRPKNRWEW
RPDFESEKVKVSLQCNSTNNLTFAMRSSGDYGEVTGAWI
EFGCHRKKSKLHSEARFRIRCRWDKGDNTSLIDTCGKTQN
VLGANPVDCTMYANRMYNCSLQNGFTMKIDDLVMHFN
MTKAVEMYNIAGNWSCTSDLPPTWGYMNCNCTNSSSTSS
SSGNKMACPGDKGILRNWYNPVAGLRQSLEKYQVVKQP
DYLVVPGEVMEYKPRRKAAIHVMLALATVLSMAGAGT
GATAIGMVTQYHQVLATHQEAIEKVTEALKINNLRLVTLE
HQVLVIGLKVEAMEKRLYTAFAMQELGCNQNQFFCKVPP
VLWERYNMTINQTIWNHGNITLGEWYNQTKDLQQKFYEI
IMDIEQNNVQGKKGLQQLQKWEDWVGWIGNIPKYLKGL
LGGILGIGLGVILLILCLPTLVDCVRNCIHKILGYTVIAMPE
VEEEEIQPQMELRRNGRQCGISEKEEE

SEQ ID NO: 392
MAEGFAVNRQWIGPEEAEELLDFDIATQMNEEGPLNPGIN
LFRVPGITETEKQEYCNILQPKLQDLRNEIQEVKLEEGNAG
KFRRARFLRYSDETILSLIHLFIGYCTYLCRNKLGTLVHN
IDIEAPQEECYSNRERGTTVNIKYSRRCCIGTTALYLLLLT
GIIIYTQTTQAQVVWRLPPLVVPVEESEIIFWDCWAPEEPA
CQDFLGAMIYLKASTNISIQEGPTLGNWAREIWGTLFKKA
TRQCRRGRIWRRWNETITGPSGCANNTCYNISVIVPDYQC
YLDRVDTWLQGKVNISLCLTGGKMLYNKDTKQLSYCTD
PLQIPLINYTFGPNQTCMWNTSQIQDSDIPKCGWWNQIAY
YNSCRWEQTDVKFHCQRTQSQPGTWLRTISSWKQKNRW
EWRPDFESEKVRVSLQCNTTKNLTFAMRSSGDYGEVTGA
WIEFGCHRNKSKLHSDARFRIRCRWNVGDNTSLIDTCGN
DPNVSGANPVDCTMYANRMYNCSLQNGFTMKVDDLIMH
FNMTKAVEMYNIAGNWSCTSDLPSTWGYMNCNCTNSSS
TDSNKMACPKRQGILRNWYNPVAGLRQSLEKYQVVKQP
DYLVVPREVMEYKPRRKRAAIHVMLALATVLSMAGAGT
GATAIGMVTQYHQVLATHQETIEKITEALKVNNLRLVTLE
HQVLVIGLKVEAIEKRLYTAFAMQELGCNQNQFFCKVPP
ELWQRYNMTINQTIWNHGNITLGEWYNQTKDLQQKFYEI
IMDMEQNNVQGRKGLQQLQEWEDWVGWLGNIPRYLKG
LLGGILGIGLGVLLLILCLPTLVDCIRNCISKVLGYTVIAMP
EVEEEEIQPPMELRRNGRQCDMSEKEEE

SEQ ID NO: 393
MAEGFAVNRQWIGPEEAEELLDFDIATQMNEEGPLNPGIN
LFRVPGITETEKQEYCNILQPKLQDLRNEIQEVKLEEGNAG
KFRRARFLRYSDETILSLIHLFIGYCTYLCRNKLGTLVHN
IDIEAPQEECYSNRERGTTVNIKYSRRCCIGTTALYLLLLT
GIIIYTQTTQAQVVWRLPPLVVPVEESEIIFWDCWAPEEPA
CQDFLGAMIYLKASTNISIQEGPTLGNWAREIWGTLFKKA
TRQCRRGRIWRRWNETITGPSGCANNTCYNISVIVPDYQC
YLDRVDTWLQGKVNISLCLTGGKMLYNKDTKQLSYCTD
PLQIPLINYTFGPNQTCMWNTSQIQDSDIPKCGWWNQIAY
YNSCRWEQTDVKFHCQRTQSQPGTWLRTISSWKQKNRW
EWRPDFESEKVRVSLQCNTTKNLTFAMRSSGDYGEVTGA
WIEFGCHRNKSKLHSDARFRIRCRWNVGDNTSLIDTCGN
DPNVSGANPVDCTMYANRMYNCSLQNGFTMKVDDLIMH
FNMTKAVEMYNIAGNWSCTSDLPSTWGYMNCNCTNSSS
TDSNKMACPKRQGILRNWYNPVAGLRQSLEKYQVVKQP
DYLVVPREVMEYKPRRKRAAIHVMLALATVLSMAGAGT
GATAIGMVTQYHQVLATHQETIEKITEALKVNNLRLVTLE
HQVLVIGLKVEAIEKFRYTAFAMQELGCNQNQFFCKVPPE
LWQRYNMTINQTIWNHGNITLGEWYNQTKDLQQKFYEII
MDMEQNNVQGRKGLQQLQEWEDWVGWLGNIPRYLKGL
LGGILGIGLGVLLLILCLPTLVDCIRNCISKVLGYTVIAMPE
VEEEEIQPPMELRRNGRQCDMSEKEEE

SEQ ID NO: 394
MAAGFSQNRQWIGPEEAEELLDFDIATQINEEGPLNPGVN
PFRVPGITDTEKQDYCKILQPKLQELREEINEVKLDEDNAG
KFRRVRYLRYADETVLSLIYALVGYLRYLGNRNKLGSLR
HDIDIEVSAKEQFDKKEKGTTINQKYCTRCCVGISVLYLIL
FIIIVAVTGSQAQVVWRHPPLVVPVEETEIIFWDCWAPEEP
ACQDFLGTMVQLKASINIGIQEGPTLGHWAREIWSTLF
KKATRQCRRGRVWRRWNETITGPLGCANNTCYNISVVVP
DYQCYVDRVDTWLQGRINISLCLTGGKMLYNKDTQQLS
YCTEPLQIPLINYTFGPNQTCMWNTSLIEDSEIPKCGWWN
QAAYYNSCKWEQTDVKFQCLRTQSQPGNWLRTISSWKQ
SNRWIWRPDFESDKVKISLQCNSTKNLTFAMRSSGDYGEI

```
TGAWIEFGCYRNKSKSHGEARFRIRCRWNEGTNTSLIDTC
GSTPNVKGANPVDCTMKANTMYNCSLQNGFTMKIEDLIV
HFNMTKAVEMYNIAGNWSCNSDIPPGWGYMNCNCTNST
SSSFPTCPKMACPRERGILRNWYNPIAGLRHALQKYQVVK
QPAYLLVPEEVMEYKPSQKRAAIHIILALATVLSIAGAGTG
ATAIGMVTQYHQVLATHQKAIDQITEALKINNLRLVTLEH
QVLVIGLKVEAIEKRIYTAFAMQELGCNQNQFFCKIPPEL
WIRYNMSINQTIWNHGNISLRDWYNNTQQLQKKFYEIIYD
IEQNNVQGKQGLQQLQKWETWVSWIGKIPQYLKGLFGSI
LGIGLGILLMILCLPTLVDCMRNCLNRVLGYTVIAMPTIDD
EGTDFPVELRRNGGQCGMSEKEEE
```

SEQ ID NO: 395
```
MAAGFSQNRQWIGPEEAEELLDFDIATQINEEGPLNPGVN
PFRVPGITDTEKQDYCKILQPKLQELREEINEVKLDEDNAG
KFRRVRYLRYADETVLSLIYALVGYLRYLGNRNKLGSLR
HDIDIEVSAKEQFDKKEKGTTINQKYCTRCCVGISVLYLIL
FIIIVAVTGSQAQVVRHPPLVVPVEETEIIFWDCWAPEEP
ACQDFLGTMVQLKASINIGIQEGPTLGHWAREIWSTLFKK
ATRQCRRGRVWRRWNETITGPLGCANNTCYNISVVVPDY
QCYVDRVDTWLQGRINISLCLTGGKMLYNKDTQQLSYCT
EPLQIPLINYTFGPNQTCMWNTSLIEDSEIPKCGWWNQAA
YYNSCKWEQTDVKFQCLRTQSQPGNWLRTISSWKQSNR
WIWRPDFESDKVKISLQCNSTKNLTFAMRSSGDYGEITGA
WIEFGCYRNKSKSHGEARFRIRCRWNEGTNTSLIDTCGST
PNVKGANPVDCTMKANTMYNCSLQNGFTMKIEDLIVHFN
MTKAVEMYNIAGNWSCNSDIPPGWGYMNCNCTNSTSSSF
PTCPKMACPRERGILRNWYNPIAGLRHALQKYQVVKQPA
YLLVPEEVMEYKPSQKRAAIHIILALATVLSIAGAGTGATA
IGMVTQYHQVLATHQKAIDQITEALKINNLRLVTLEHQVL
VIGLKVEAIEKFRYTAFAMQELGCNQNQFFCKIPPELWIR
YNMSINQTIWNHGNISLRDWYNNTQQLQKKFYEIIYDIEQ
NNVQGKQGLQQLQKWETWVSWIGKIPQYLKGLFGSILGI
GLGILLMILCLPTLVDCMRNCLNRVLGYTVIAMPTIDDEG
TDFPVELRRNGGQCGMSEKEEE
```

SEQ ID NO: 396
```
MAAGFTQNRQWIGPEEAEELLDFDIVTQINEEGPLNPGVN
PFRVPAITDTEKQDYCKILQPKLQELREEIKETKLDESNAG
KFRRVRYLRYADETALSLIYALVGYLRYLLERRKLGSLR
HDVDIEVSAKEQFNKKEKGTTVNQNYCTKCCVGISVLYFI
LFLILAVTRSQAQVVWRLPPLVVPVEETEIIFWDCWAPE
EPACQDFLGTMVQLKASINISIQEGPTLGHWAREILETLF
KKATRQCRRGRVWKRWNETITGPLGCANNTCYNISVVVP
DYQCYVDRVDTWLQGRINISLCLTGGKMLYNKDTQQLS
YCTEPLQIPLINYTFGPNQTCMWNTSLIEDSEIPKCGWWN
QAAYYNSCKWEQTDVKFQCQRTQSQPGTWLRAIASWKQ
ANRWIWRPDFESDKVKISLQCNSTKNLTFAMRSSSDYGEI
TGAWIEFGCYRNKSKFHDEARFRIRCRWNEGTNTSLIDTC
GDNPNVTGANPVDCTMRANIMYNCSLQNGFTMKIEDLIV
HFNMTKAVEMYNIAGNWSCTSDLPKGWGYMNCNCTNG
TDNTKMTCPENQGILRNWYNPVAGLRQALMKYQVVKQP
EYLIVPEEVMQYKSKQKRAAIHIMLALATVLSMAGAGTG
ATAIGMVTQYHQVLATHQQALDKITEALKINNLRLITLEH
QVLVIGLKVEAIEKRLYTAFAMQELGCNQNQFFCKIPPSL
WSMYNMTLNQTIWNHGNISLGNWYNQTRDLQNKFYEII
MDIEQNNVQGKTGIQQLQKWENWVGWIGKIPQYLKGLL
GSVLGIGLGILLLLICLPTLVDCIRNCTNKILGYTVIAMPEI
DDEEVHLSVELRRNGRQCGISEKEEE
```

SEQ ID NO: 397
```
MAAGFTQNRQWIGPEEAEELLDFDIVTQINEEGPLNPGVN
PFRVPAITDTEKQDYCKILQPKLQELREEIKETKLDESNAG
KFRRVRYLRYADETALSLIYALVGYLRYLLERRKLGSLR
HDVDIEVSAKEQFNKKEKGTTVNQNYCTKCCVGISVLYFI
LFLILAVTRSQAQVVWRLPPLVVPVEETEIIFWDCWAPE
EPACQDFLGTMVQLKASINISIQEGPTLGHWAREILETLF
KKATRQCRRGRVWKRWNETITGPLGCANNTCYNISVVVP
DYQCYVDRVDTWLQGRINISLCLTGGKMLYNKDTQQLS
YCTEPLQIPLINYTFGPNQTCMWNTSLIEDSEIPKCGWWN
QAAYYNSCKWEQTDVKFQCQRTQSQPGTWLRAIASWKQ
ANRWIWRPDFESDKVKISLQCNSTKNLTFAMRSSSDYGEI
TGAWIEFGCYRNKSKFHDEARFRIRCRWNEGTNTSLIDTC
GDNPNVTGANPVDCTMRANIMYNCSLQNGFTMKIEDLIV
HFNMTKAVEMYNIAGNWSCTSDLPKGWGYMNCNCTNG
TDNTKMTCPENQGILRNWYNPVAGLRQALMKYQVVKQP
EYLIVPEEVMQYKSKQKRAAIHIMLALATVLSMAGAGTG
ATAIGMVTQYHQVLATHQQALDKITEALKINNLRLITLEH
QVLVIGLKVEAIEKFRYTAFAMQELGCNQNQFFCKIPPSL
WSMYNMTLNQTIWNHGNISLGNWYNQTRDLQNKFYEII
MDIEQNNVQGKTGIQQLQKWENWVGWIGKIPQYLKGLL
GSVLGIGLGILLLLICLPTLVDCIRNCTNKILGYTVIAMPEI
DDEEVHLSVELRRNGRQCGISEKEEE
```

SEQ ID NO: 398
```
MAEGFCQNRQWIGPEEAEELLDFDIATQVSEEGPLNPGIN
PFRQPGLTDGEKEEYCKILQPRLQALREEYKEGSLNSESA
```

-continued

GKYRRVRYLRYSDLRVLSLLYLFIGYLAFFVKRGLGKQ
RQDIDIESKGTEEKFSKNEKGQTVNIRNCRILTIAICSFYIFL
FIGIGIYAGKGEAQVIWRLPPLVVPVEDSEIIFWDCWAPEE
PACQDFLGAMMHLKASTNISIQEGPTLGKWAKEIWATLF
KKATRQCRRGKVWRKWNETITGPKGCANNTCYNVTVSIP
DYQCYLDRVDTWLQGKVNISLCLTGGKMLYNKETKQLS
YCTDPLQIPLINYTFGPNQTCMWNTSLIKNPDIPKCWWN
QAVYYNSCRWEKADVQFQCQRTQSQPGTWLRKISSWKQ
KNRWEWRPDFESERVKISLQCNSTKNLTFAMRSSSDYSD
VVGAWIEFGCHRNKSRRHTDARFRIRCKWNVGSNTSLID
TCGKENITGANPVDCTMTAKTLYNCSLQEGFTMKIEDLIM
HFNMTKAVEMYEIAGNWSCKSDLPTDWGYMKCNCTSRN
ESEKMKCPAKDGILRNWYNPVAGLRQALDKYQVVKQPD
YIVVPEEVLNYQSRQKRAAIHIMLALATVLSIAGAGTGAT
AIGMVTQYHQVLATHQEALDKITEALKINNLRLVTLEHQ
VLVIGLKVEATEKRLYTAFAMQELGCNQNQFFCKIPCEL
WMRYNLTLNQTIWNHGNVTLQDWYNQTKQLQQKFYEII
MDIEQNNVQGKKGIQQLQSWEYWTGWMGKIPQYLKGLL
GGVLGIGLGILLLILCLPTLLDCMRNCINKVMGYTVIVMPE
IDDEELSQNMELRRNGRQCGMSEKEEE

SEQ ID NO: 399
MAEGFCQNRQWIGPEEAEELLDFDIATQVSEEGPLNPGIN
PFRQPGLTDGEKEEYCKILQPRLQALREEYKEGSLNSESA
GKYRRVRYLRYSDLRVLSLLYLFIGYLAFFVKRGLGKQ
RQDIDIESKGTEEKFSKNEKGQTVNIRNCRILTIAICSFYIFL
FIGIGIYAGKGEAQVIWRLPPLVVPVEDSEIIFWDCWAPEE
PACQDFLGAMMHLKASTNISIQEGPTLGKWAKEIWATLF
KKATRQCRRGKVWRKWNETITGPKGCANNTCYNVTVSIP
DYQCYLDRVDTWLQGKVNISLCLTGGKMLYNKETKQLS
YCTDPLQIPLINYTFGPNQTCMWNTSLIKNPDIPKCWWN
QAVYYNSCRWEKADVQFQCQRTQSQPGTWLRKISSWKQ
KNRWEWRPDFESERVKISLQCNSTKNLTFAMRSSSDYSD
VVGAWIEFGCHRNKSRRHTDARFRIRCKWNVGSNTSLID
TCGKENITGANPVDCTMTAKTLYNCSLQEGFTMKIEDLIM
HFNMTKAVEMYEIAGNWSCKSDLPTDWGYMKCNCTSRN
ESEKMKCPAKDGILRNWYNPVAGLRQALDKYQVVKQPD
YIVVPEEVLNYQSRQKRAAIHIMLALATVLSIAGAGTGAT
AIGMVTQYHQVLATHQEALDKITEALKINNLRLVTLEHQ
VLVIGLKVEATEKFRYTAFAMQELGCNQNQFFCKIPCEL
WMRYNLTLNQTIWNHGNVTLQDWYNQTKQLQQKFYEII
MDIEQNNVQGKKGIQQLQSWEYWTGWMGKIPQYLKGLL
GGVLGIGLGILLLILCLPTLLDCMRNCINKVMGYTVIVMPE
IDDEELSQNMELRRNGRQCGMSEKEEE

SEQ ID NO: 400
MAEGGFAQNQQWIGPEEAEELLDFDIAVQMNEEGPLNPG
VNPFRVPGITPQEKDNYCTILQPRLQELKREIKEVKIEEEN
AGKFRRARFLRYSDENVLSIVYLLTGYLRYLIDRKSLGSL
RHDIDIEVPQKEQYSNNEKGNTVNRKYGRICCISTLFLYLL
LFAGIGVWYGTTAQVVWRLPPLVVPIDDTEIIFWDCWAPE
EPACQDFLGAMIHLKANINISIQEGPTLGNWAREIWSTLFK
KATRQCRRGRIWRRWNETITGPLGCANNTCYNISVVIPDY
QCYVDRVDTWLQGKVNISLCLTGGKMLFNKETKQLSYC
TDPLQIPLINYTFGPNQTCEWNTSLIKDPEIPKCGWWNQN
AYYNSCKWEQTDVKFQCQRIQSQPGSWIRAISSWRQRNR
WEWRPDFESEKVKISLQCNSTRNLTFAMRSSSDYYDVQG
AWIEFGCYRNKSIRHTGTRFRIRCRWNEGKNMSLIDTCGT
DPNVTRANPVNCTLKTNTMYNCTLQDSFTMKIEDLIVHF
NMSKAVEMYNIAGNWSCTSDLPTGWGYMKCNCTSTNNT
GKMKCPEPEGILRNWYNPVAGLRQALMKYQVVKQPEYL
IVPEEVMKYKSKQKRAAIHIMLALATVLSIAGAGTGATAI
GMVTQYHQVLATHQQALEKITEALKINNLRLVTLEHQVL
MIGLKVEAIEKRLYTAFAMQELGCNQNQFFCKIPLNLWT
MYNMTINQTLWNHGNITLGDWYNQTKGLQEKFYEIIMDL
EQNNVQGKLGIQQLQKWENWVGWIGKIPQYLKGLLGSV
LGIGVGILLLIICLPTLVDCIRNCINKVLGYSVIAMPELDDE
EVSMELRRNGRQCGMSEKEEE

SEQ ID NO: 401
MAEGGFAQNQQWIGPEEAEELLDFDIAVQMNEEGPLNPG
VNPFRVPGITPQEKDNYCTILQPRLQELKREIKEVKIEEEN
AGKFRRARFLRYSDENVLSIVYLLTGYLRYLIDRKSLGSL
RHDIDIEVPQKEQYSNNEKGNTVNRKYGRICCISTLFLYLL
LFAGIGVWYGTTAQVVWRLPPLVVPIDDTEIIFWDCWAPE
EPACQDFLGAMIHLKANINISIQEGPTLGNWAREIWSTLFK
KATRQCRRGRIWRRWNETITGPLGCANNTCYNISVVIPDY
QCYVDRVDTWLQGKVNISLCLTGGKMLFNKETKQLSYC
TDPLQIPLINYTFGPNQTCEWNTSLIKDPEIPKCGWWNQN
AYYNSCKWEQTDVKFQCQRIQSQPGSWIRAISSWRQRNR
WEWRPDFESEKVKISLQCNSTRNLTFAMRSSSDYYDVQG
AWIEFGCYRNKSIRHTGTRFRIRCRWNEGKNMSLIDTCGT
DPNVTRANPVNCTLKTNTMYNCTLQDSFTMKIEDLIVHF
NMSKAVEMYNIAGNWSCTSDLPTGWGYMKCNCTSTNNT
GKMKCPEPEGILRNWYNPVAGLRQALMKYQVVKQPEYL

IVPEEVMKYKSKQKRAAIHIMLALATVLSIAGAGTGATAI
GMVTQYHQVLATHQQALEKITEALKINNLRLVTLEHQVL
MIGLKVEAIEKFRYTAFAMQELGCNQNQFFCKIPLNLWT
MYNMTINQTLWNHGNITLGDWYNQTKGLQEKFYEIIMDL
EQNNVQGKLGIQQLQKWENWVGWIGKIPQYLKGLLGSV
LGIGVGILLLIICLPTLVDCIRNCINKVLGYSVIAMPELDDE
EVSMELRRNGRQCGMSEKEEE

SEQ ID NO: 402
MAEGGFTQNHQWIGPEEAEELLDFDIAIQMNEEGPLNPGV
NPFRVPGITSQEKDDYCKILQTKLQELKNEVKEVKIEEGN
AGKFRRARFLRYSDENVLSIVYLLIGYLRYLIDHRSLGSLR
HDIDIEAPQEEHYNNSEKGTTLNIKYGRRCCISTFIMYLILF
AGVGIWFGARAQVVWRLPPLVVPVDDTEIIFWDCWAPEE
PACQDFLGTMIHLKAKTNISIQEGPTLGNWAREIWATLFK
KATRQCRRGRIWRRWNETITGPLGCANNTCYNISVVVPD
YQCYLDRVDTWLQGKLNISLCLTGGKMLYNKVTKQLSY
CTDPLQIPLINYTFGPNQTCMWNTSQIQDPEIPKCGWWNQ
MAYYNSCKWEEAKVKFHCQRTQSQPGSWHRAISSWKQR
NRWEWRPDFKSKKVKISLQCNSTKNLTFAMRSSSDYYDV
QGAWIEFGCHRNKSKGFSEARFRTRCKWNEGNNISLIDTC
GTNPNVTGANPVDCTMKANIMYNCSLQDSFTMKIEDLIV
HFNMTKAVEMYNIAGNWSCTSDLPKGWGYMNCNCTNG
TDNSKTKMACPRNQGILRNWYNPVAGLRQALIKYQVVK
QPEYLIVPEEVMQYKVKQKRAAIHIMLALATVLSMAGAG
TGATAIGMVTQYHQVLATHQHALDKITEALKINNLRLITL
VHQVLVIGLKVRAIEKRLYTAFAMQELGCNQNQFFCKIPP
SLWSMYNMTLNQTIWNHGNISLGNWYNQTRDLQNKFYE
IIMDIEQNNVQGKTGIQQLQKWENWVGWIGKIPQYLKGL
LGSVLGIGLGILLLLICLPTLVDCIRNCTHKILGYTVIAMPEI
DDEEVHLSVELRRNGRQCGISEKEEE

SEQ ID NO: 403
MAEGGFTQNHQWIGPEEAEELLDFDIAIQMNEEGPLNPGV
NPFRVPGITSQEKDDYCKILQTKLQELKNEVKEVKIEEGN
AGKFRRARFLRYSDENVLSIVYLLIGYLRYLIDHRSLGSLR
HDIDIEAPQEEHYNNSEKGTTLNIKYGRRCCISTFIMYLILF
AGVGIWFGARAQVVWRLPPLVVPVDDTEIIFWDCWAPEE
PACQDFLGTMIHLKAKTNISIQEGPTLGNWAREIWATLFK
KATRQCRRGRIWRRWNETITGPLGCANNTCYNISVVVPD
YQCYLDRVDTWLQGKLNISLCLTGGKMLYNKVTKQLSY
CTDPLQIPLINYTFGPNQTCMWNTSQIQDPEIPKCGWWNQ
MAYYNSCKWEEAKVKFHCQRTQSQPGSWHRAISSWKQR
NRWEWRPDFKSKKVKISLQCNSTKNLTFAMRSSSDYYDV
QGAWIEFGCHRNKSKGFSEARFRTRCKWNEGNNISLIDTC
GTNPNVTGANPVDCTMKANIMYNCSLQDSFTMKIEDLIV
HFNMTKAVEMYNIAGNWSCTSDLPKGWGYMNCNCTNG
TDNSKTKMACPRNQGILRNWYNPVAGLRQALIKYQVVK
QPEYLIVPEEVMQYKVKQKRAAIHIMLALATVLSMAGAG
TGATAIGMVTQYHQVLATHQHALDKITEALKINNLRLITL
VHQVLVIGLKVRAIEKPRYTAFAMQELGCNQNQFFCKIPP
SLWSMYNMTLNQTIWNHGNISLGNWYNQTRDLQNKFYE
IIMDIEQNNVQGKTGIQQLQKWENWVGWIGKIPQYLKGL
LGSVLGIGLGILLLLICLPTLVDCIRNCTHKILGYTVIAMPEI
DDEEVHLSVELRRNGRQCGISEKEEE

SEQ ID NO: 404
MAEGFAANRQWIGPEEAEELLDFDKATQMNEEGPLNPGV
NPFRVPAVTEADKQEYCKILQPRLQEIRNEIQEVKLEEGN
AGKFRRARFLRYSDESILSLIHLFIGYCTYLVNRRRLGSLR
HDINIEAPQEEQYSSREQGTTENIKYGRRCLIGTASLYLLLF
IGVAIYLGTTNAQIVWRLPPLVVPVEESEIIFWDCWAPEEP
ACQDFLGAMIHLKASTNISIQEGPTLGNWAREIWGTLFKK
ATRHCRRNKIWKRWNETITGPVGCANNTCYNISVIIPDYQ
CYLDRVDTWLQGKVNISLCLTGGKMLYNRDTKQLSYCT
DPLQIPLINYTFGPNQTCMWNTSQIQDPEIPKCGWWNQIA
YYNSCRWESTNVKFYCQRTQSQPGTWIRTISSWRQKNRW
EWRPDFESEKVKISLQCNSTHNLTFAMRSSGDYGEVMGA
WIEFGCHRNKSRFHTEARFRIRCRWNVGDNTSLIDTCGKN
LNVSGANPVDCTMYANKMYNCSLQNGFTMKVDDLIMHF
NMTKAVEMYNIAGNWSCKSDLPQNWGYMNCNCTNGTS
NDNKMACPEDKGILRNWYNPVAGLRQALEKYQVVKQPE
YIVVPTEVMTYKYKQKRAAIHIMLALATVLSIAGAGTGAT
AIGMVTQYQQVLATHQEALDKITEALKINNLRLVTLEHQ
MLVIGLKVEAIEKRLYTAFAMQELGCNQNQFFCEIPKELW
LRYNMTLNQTIWNHGNITLGEWYNQTKYLQQKFYEIIMD
IEQNNVQGKQGLQKLQNWQDWMGWIGKIPQYLKGLLGG
ILGIGLGILLLILCLPTLVDCIRNCISKVLGYTVIAMPEIDDE
EETVQMELRKNGRQCGMSEKEEE

SEQ ID NO: 405
MAEGFAANRQWIGPEEAEELLDFDKATQMNEEGPLNPGV
NPFRVPAVTEADKQEYCKILQPRLQEIRNEIQEVKLEEGN
AGKFRRARFLRYSDESILSLIHLFIGYCTYLVNRRRLGSLR
HDINIEAPQEEQYSSREQGTTENIKYGRRCLIGTASLYLLLF
IGVAIYLGTTNAQIVWRLPPLVVPVEESEIIFWDCWAPEEP
ACQDFLGAMIHLKASTNISIQEGPTLGNWAREIWGTLFKK

ATRHCRRNKIWKRWNETITGPVGCANNTCYNISVIIPDYQ
CYLDRVDTWLQGKVNISLCLTGGKMLYNRDTKQLSYCT
DPLQIPLINYTFGPNQTCMWNTSQIQDPEIPKCGWWNQIA
YYNSCRWESTNVKFYCQRTQSQPGTWIRTISSWRQKNRW
EWRPDFESEKVKISLQCNSTHNLTFAMRSSGDYGEVMGA
WIEFGCHRNKSRFHTEARFRIRCRWNVGDNTSLIDTCGKN
LNVSGANPVDCTMYANKMYNCSLQNGFTMKVDDLIMHF
NMTKAVEMYNIAGNWSCKSDLPQNWGYMNCNCTNGTS
NDNKMACPEDKGILRNWYNPVAGLRQALEKYQVVKQPE
YIVVPTEVMTYKYKQKRAAIHIMLALATVLSIAGAGTGAT
AIGMVTQYQQVLATHQEALDKITEALKINNLRLVTLEHQ
MLVIGLKVEAIEKFRYTAFAMQELGCNQNQFFCEIPKELW
LRYNMTLNQTIWNHGNITLGEWYNQTKYLQQKFYEIIMD
IEQNNVQGKQGLQKLQNWQDWMGWIGKIPQYLKGLLGG
ILGIGLGILLLILCLPTLVDCIRNCISKVLGYTVIAMPEIDDE
EETVQMELRKNGRQCGMSEKEEE

SEQ ID NO: 406
MAEGGFTQNQQWIGPEEAEELLDFDIAVQMNEEGPLNPG
VNPFRVPGITSQEKEDYCKILQTKLQELKNEVKGVKIEEG
NAGKFRRARYLRYSDENVLSIVYLLIGYLRYLIDHRSLGSL
RHDIDIETPQEEHFNNSEKGTTLNTKYGRRCCLSTFIMNLI
LFAGVGIWLGARAQVVWRLPPLVVPVDDTEIIFWDCWAP
EEPACQDFLGTMVQLKASINISIQEGPTLGHWAREILETLF
KKATRQCRRGRVWRRWNETITGPLGCANNACYNISVVVP
DYQCYVDRVDTWLQGRINISLCLTGGKMLYNKDTQQLS
YCTEPLQIPLINYTFGPNQTCMWNTSLIEDSEIPKCGWWN
QAAYYNSCKWEQTDVKFQCQRTQSQPGTWLRAIASWEQ
ANRWIWRPDFESDKVKISLQCNSTKNLTFAMRSSSDYYD
VQGAWIEFGCHRNKSRRHSEARFRIRCKWNEGKNISLIDT
CGTNPNVTGANPVDCTMKANTMYNCSLQDSFTMKIEDLI
VHFNMTKAVEMYNIAGNWSCTSDLPKGWGYMNCNCTN
GTDDSKTKMACPENQGILRNWYNPVAGLRQALIKYHVV
KQPEYLIVPEEVMQYKVKQKRAAIHIMLALATVLSMAGA
GTGATAIGMVTQYHQVLATHQQALDKITEALKINNLRLIT
LEHQVLVIGLKVEAIEKRLYTAFAMQELGCNQNQFFCKIP
PSLWSMYNMTLNQTIWNHGNISLGNWYNQTRDLQNKFY
EIIMDIEQNNVQGKTGIQQLQKWENWMGWIGKIPQYLKG
LLGSVLGIGLGILLLLICLPTLVDCIRNCTNKILGYTVIAMP
EIDDEEVHLSVELRRNGRQCGISEKEEE

SEQ ID NO: 407
MAEGGFTQNQQWIGPEEAEELLDFDIAVQMNEEGPLNPG
VNPFRVPGITSQEKEDYCKILQTKLQELKNEVKGVKIEEG
NAGKFRRARYLRYSDENVLSIVYLLIGYLRYLIDHRSLGSL
RHDIDIETPQEEHFNNSEKGTTLNTKYGRRCCLSTFIMNLI
LFAGVGIWLGARAQVVWRLPPLVVPVDDTEIIFWDCWAP
EEPACQDFLGTMVQLKASINISIQEGPTLGHWAREILETLF
KKATRQCRRGRVWRRWNETITGPLGCANNACYNISVVVP
DYQCYVDRVDTWLQGRINISLCLTGGKMLYNKDTQQLS
YCTEPLQIPLINYTFGPNQTCMWNTSLIEDSEIPKCGWWN
QAAYYNSCKWEQTDVKFQCQRTQSQPGTWLRAIASWEQ
ANRWIWRPDFESDKVKISLQCNSTKNLTFAMRSSSDYYD
VQGAWIEFGCHRNKSRRHSEARFRIRCKWNEGKNISLIDT
CGTNPNVTGANPVDCTMKANTMYNCSLQDSFTMKIEDLI
VHFNMTKAVEMYNIAGNWSCTSDLPKGWGYMNCNCTN
GTDDSKTKMACPENQGILRNWYNPVAGLRQALIKYHVV
KQPEYLIVPEEVMQYKVKQKRAAIHIMLALATVLSMAGA
GTGATAIGMVTQYHQVLATHQQALDKITEALKINNLRLIT
LEHQVLVIGLKVEAIEKRLYTAFAMQELGCNQNQFFCKIP
PSLWSMYNMTLNQTIWNHGNISLGNWYNQTRDLQNKFY
EIIMDIEQNNVQGKTGIQQLQKWENWMGWIGKIPQYLKG
LLGSVLGIGLGILLLLICLPTLVDCIRNCTNKILGYTVIAMP
EIDDEEVHLSVELRRNGRQCGISEKEEE

SEQ ID NO: 408
MAEGGFTQNQQWIGPEEAEELLDFDIAVQMNEEGPLNPG
VNPFRVPGITSQEKEDYCKTLQTNLQELKNEVKEVKIEEG
NAGKFRRARFLRYSDENVLSIVYLLIGYLRYLIDHRSLGSL
RHDIDIEAPQEEHYNNSEKGTTLNIKYARRCCISTFIMYLIL
FAGVGIWLGARAQVVWRLPPLVVPVDDTEIIFWDCWAPE
EPACQDFLGTMVQLKASINIGIQEGPTLGHWAREIWSTLF
KKATRQCRRGRVWRRWNETITGPLGCANNTCYNISVVVP
DYQCYVDRVDTWLQGRINISLCLTGGKMLYNKDTHQLS
YCTEPLQIPLINCTFGPIQTCMWNTSLIQDPEIPKCGWWTQ
VAYYNNCKWEEANVTFQCHRTQSRSGSWLRTISSWRQR
NRWEWRPDFESEKVKISLQCNSTKNLTFAMRSSSDYYDV
QGAWIEFGCHRNKSKKHSEARFRIRCKWNEGNNISLIDTC
GTNPNVTGANPVDCTMKANTMYNCSLQDSFTMKIEDLIV
HFNMTKAVEMYNIAGNWSCTSDLPKGWGYMNCNCTNG
TDDSKTKMACPENQGILRNWYNPVAGLRQALIKYQVVK
QPEYLIVPEEVMQYKVKQKRAAIHIMLALATVLSMAGAG
TGATAIGMVTQYHQVLATHQQALDKITEALKINNLRLITL
EHQVLVIGLKVEAIEKRLYTAFAMQELGCNQNQFFCKIPP
SLWSMYNMTLNQTIWNHGNISLGNWYNQTRDLQNKFYE
IIMDIEQNNVQGKTGIQQLQKWENWVGWIGKIPQYLKGL

-continued

LGSVLGIGLGILLLLICLPTLVDCIRNCTNKILGYTVIAMPEI

DDEEVHLSVELRRNGRQCGISEKEEE

SEQ ID NO: 409
MAEGGFTQNQQWIGPEEAEELLDFDIAVQMNEEGPLNPG

VNPFRVPGITSQEKEDYCKTLQTNLQELKNEVKEVKIEEG

NAGKFRRARFLRYSDENVLSIVYLLIGYLRYLIDHRSLGSL

RHDIDIEAPQEEHYNNSEKGTTLNIKYARRCCISTFIMYLIL

FAGVGIWLGARAQVVWRLPPLVVPVDDTEIIFWDCWAPE

EPACQDFLGTMVQLKASINIGIQEGPTLGHWAREIWSTLF

KKATRQCRRGRVWRRWNETITGPLGCANNTCYNISVVVP

DYQCYVDRVDTWLQGRINISLCLTGGKMLYNKDTHQLS

YCTEPLQIPLINCTFGPIQTCMWNTSLIQDPEIPKCGWWTQ

VAYYNNCKWEEANVTFQCHRTQSRSGSWLRTISSWRQR

NRWEWRPDFESEKVKISLQCNSTKNLTFAMRSSSDYYDV

QGAWIEFGCHRNKSKKHSEARFRIRCKWNEGNNISLIDTC

GTNPNVTGANPVDCTMKANTMYNCSLQDSFTMKIEDLIV

HFNMTKAVEMYNIAGNWSCTSDLPKGWGYMNCNCTNG

TDDSKTKMACPENQGILRNWYNPVAGLRQALIKYQVVK

QPEYLIVPEEVMQYKVKQKRAAIHIMLALATVLSMAGAG

TGATAIGMVTQYHQVLATHQQALDKITEALKINNLRLITL

EHQVLVIGLKVEAIEKFRYTAFAMQELGCNQNQFFCKIPP

SLWSMYNMTLNQTIWNHGNISLGNWYNQTRDLQNKFYE

IIMDIEQNNVQGKTGIQQLQKWENWVGWIGKIPQYLKGL

LGSVLGIGLGILLLLICLPTLVDCIRNCTNKILGYTVIAMPEI

DDEEVHLSVELRRNGRQCGISEKEEE

SEQ ID NO: 410
MAEGGFTHNQQWIGPEEAEELLDFDIAVQMNEEGPLNPG

VNPFRVPGITSQEKDDYCKILQTKLQELKNEVKEVKIEEG

NAGKFRRARYLRYSDENVLSIVYLLIGYLRYLIDHRSLGSL

RHDIDIETPQEEHYNNSEKGTTLNIKYGRRCCISTFIMYLIL

FAGVGIWLGARAQVVWRLPPLVVPVDDTEIIFWDCWAPE

EPACQDFLGTMIYLKANVNISIQEGPTLGNWAREIWSTLF

KKATRQCRRGRIWRRWNETITGPLGCANNTCYNISVVVP

DYQCYVDRVDTWLQGKVNISLCLTGGKMLYNKETRQLS

YCTDPLQIPLINYTFGPNQTCMWNTSLIKDSEIPKCGWWN

QVAYYDTCKWEEANVTFQCHRTQSQSGSWIRTISSWKQR

NRWEWRPDFESEKVKISLQCNSTKNLTFAMRSSSDYYDV

QGAWIEFGCHRNKSKRHSEARFRIRCKWNEGNNISLIDTC

GTNPNVTGANPVDCTMKANTMYNCSLQDSFTMKIEDLIV

HFNMTKAVELYNIAGNWSCTSDLPKGWGYMNCNCTNGT

DNSETKMACPKNQGILRNWYNPVAGLRQALIKYQVVKQ

PEYLIVPEEVMQYKFKQKRAAIHIMLALATVLSMAGAGT

GATAIGMVTQYHQVLATHQQALEKITEALKINNLRLITLE

HQVLVIGLRVEAIEKRLYTAFAMQELGCNQNQFFCKIPPS

LWSMYNMTLNQTIWNHGNISLGNWYNQTRDLQNKFYEII

MDIEQNNVQGKTGIQQLQKWENWVGWIGKIPQYLKGLL

GSVLGIGLGILLLLICLPTLVDCIRNCTNKILGYTVIAMPEI

DDEEVHLSVELRRNGRQCGISEKEEE

SEQ ID NO: 411
MAEGGFTHNQQWIGPEEAEELLDFDIAVQMNEEGPLNPG

VNPFRVPGITSQEKDDYCKILQTKLQELKNEVKEVKIEEG

NAGKFRRARYLRYSDENVLSIVYLLIGYLRYLIDHRSLGSL

RHDIDIETPQEEHYNNSEKGTTLNIKYGRRCCISTFIMYLIL

FAGVGIWLGARAQVVWRLPPLVVPVDDTEIIFWDCWAPE

EPACQDFLGTMIYLKANVNISIQEGPTLGNWAREIWSTL

FKKATRQCRRGRIWRRWNETITGPLGCANNTCYNISVVV

PDYQCYVDRVDTWLQGKVNISLCLTGGKMLYNKETRQL

SYCTDPLQIPLINYTFGPNQTCMWNTSLIKDSEIPKCGWW

NQVAYYDTCKWEEANVTFQCHRTQSQSGSWIRTISSWKQ

RNRWEWRPDFESEKVKISLQCNSTKNLTFAMRSSSDYYD

VQGAWIEFGCHRNKSKRHSEARFRIRCKWNEGNNISLIDT

CGTNPNVTGANPVDCTMKANTMYNCSLQDSFTMKIEDLI

VHFNMTKAVELYNIAGNWSCTSDLPKGWGYMNCNCTN

GTDNSETKMACPKNQGILRNWYNPVAGLRQALIKYQVV

KQPEYLIVPEEVMQYKFKQKRAAIHIMLALATVLSMAGA

GTGATAIGMVTQYHQVLATHQQALEKITEALKINNLRLIT

LEHQVLVIGLRVEAIEKFRYTAFAMQELGCNQNQFFCKIP

PSLWSMYNMTLNQTIWNHGNISLGNWYNQTRDLQNKFY

EIIMDIEQNNVQGKTGIQQLQKWENWVGWIGKIPQYLKG

LLGSVLGIGLGILLLLICLPTLVDCIRNCTNKILGYTVIAMP

EIDDEEVHLSVELRRNGRQCGISEKEEE

SEQ ID NO: 412
MAEGGFTQNQQWIGPEEAEELLDFDIAVQMNEEGPLHPGI

NPFRVPGITPQEKEDYCKILQPKLQELKGEIKEVKLEERNA

GKFRRARYLRYSDENVLSIIYLLTGYFRYLINHRSLGALRH

DIDIEAPQKEQYSNNEKGTTLNIKYGRVCCISTLLLYLLLF

AGLGVWYGTSAQVVWRLPPLVVPVEDTEIIFWDCWAPEE

PACQDFLGTMIHLKANVNISIQEGPTLGNWAREIWSTLFK

KATRQCRRGRIWRRWNETITGPLGCANNTCYNISVVVPD

YQCYVDRVDTWLQGKVNISLCLTGGKMLYNKETRQLSY

CTDPLQIPLINYTFGPNQTCMWNTSLIKDSEIPKCGWWNQ

VAYYNACKWEEANVTFQCHRTQSQPGSWIRTISSWKQRN

RWEWRPDFESEKVKISLQCNSTKNLTFAMRSSSDYYDIQG

-continued

AWIEFGYHRNKSKMHSEVRFRIRCKWNEGNNISLIDTCGT
NPNVTGANPVDCTMKANTMYNCSLQDSFTMKIEDLIVHF
NMTKAVEMYNIAGNWSCTSDLPKGWGYMNCNCTNGTD
ESGTKMACPKSQGILRNWYNPVAGLRQALIKYQVVKQPE
YLIVPEEVMQYKFKQKRAAIHIMLALATVLSMAGAGTGA
TAIGMVTQYHQVLATHQQALDKITQALKINNLRLITLEHQ
VLVIGLKVEAIEKRLYTAFAMQELGCNQNQFFCKIPPSLW
SMYNMTLNQTIWNHGNISLGNWYNQTKDLQNKFYEIIMD
IEQNNVQGKTGIQQLQKWENWVGWIGKIPQYLKGLLGSV
LGIGVGILLLIICLPTLVDCVRNCINKVLGYSVIAMPELDDE
EVSMELRRNGRQCGMSEKEEE

SEQ ID NO: 413
MAEGGFTQNQQWIGPEEAEELLDFDIAVQMNEEGPLHPGI
NPFRVPGITPQEKEDYCKILQPKLQELKGEIKEVKLEERNA
GKFRRARYLRYSDENVLSIIYLLTGYFRYLINHRSLGALRH
DIDIEAPQKEQYSNNEKGTTLNIKYGRVCCISTLLLYLLLF
AGLGVWYGTSAQVVWRLPPLVVPVEDTEIIFWDCWAPEE
PACQDFLGTMIHLKANVNISIQEGPTLGNWAREIWSTLFK
KATRQCRRGRIWRRWNETITGPLGCANNTCYNISVVVPD
YQCYVDRVDTWLQGKVNISLCLTGGKMLYNKETRQLSY
CTDPLQIPLINYTFGPNQTCMWNTSLIKDSEIPKCGWWNQ
VAYYNACKWEEANVTFQCHRTQSQPGSWIRTISSWKQRN
RWEWRPDFESEKVKISLQCNSTKNLTFAMRSSSDYYDIQG
AWIEFGYHRNKSKMHSEVRFRIRCKWNEGNNISLIDTCGT
NPNVTGANPVDCTMKANTMYNCSLQDSFTMKIEDLIVHF
NMTKAVEMYNIAGNWSCTSDLPKGWGYMNCNCTNGTD
ESGTKMACPKSQGILRNWYNPVAGLRQALIKYQVVKQPE
YLIVPEEVMQYKFKQKRAAIHIMLALATVLSMAGAGTGA
TAIGMVTQYHQVLATHQQALDKITQALKINNLRLITLEHQ
VLVIGLKVEAIEKFRYTAFAMQELGCNQNQFFCKIPPSLW
SMYNMTLNQTIWNHGNISLGNWYNQTKDLQNKFYEIIMD
IEQNNVQGKTGIQQLQKWENWVGWIGKIPQYLKGLLGSV
LGIGVGILLLIICLPTLVDCVRNCINKVLGYSVIAMPELDDE
EVSMELRRNGRQCGMSEKEEE

SEQ ID NO: 414
MAEGGFTQNQQWIGPEEAEELLDFDIAVQMNEEGPLNPG
VNPFRVPGITSQEKDDYCKVLQTKLQELKNEVKEVKIEEG
NAGKFRRARYLRYSDENVLSIVYLLIGYLRYLIDHRSLGSL
RHDIDIETPQEEHYNNSEKGTTLNTKYGRRCCLSTFIMYL
VLFAGVGLWLGARAQVVWRLPPLVVPVDDTEIIFWDCW
APEEPACQDFLGTMIYLKANVNISIQEGPTLGNWAREIWS

TLFKKATRQCRRGRIWKRWNETITGPLGCATNTCYNISVV
VPDYQCYVDRVDTWLQGKVNISLCLTGGKMLYNKETRQ
LSYCTDPLQIPLINYTFGPNQTCMWNTSLIKDSEIPKCGW
WNQVAYYNACKWEEANVTFQCQRTQSQSGSWIRTISSW
KQRNRWEWRPDFESEKVKISLQCNSTKNLTFAMRSSSDY
YDVQGAWIEFGCHRNKSKKYSEARFRIRCKWNEGKNISLI
DTCGTNPNVTGANPVDCTMKANTMYNCSLQDSFTMKIE
DLIVHFNMTKAVEMYNIAGNWSCTSDLPKGWGYMNCNC
TNGTDNSETKMTCPENQGILRNWYNPVAGLRQALIKYQV
VKQPEYLIVPEEVMQYKFKQKRAAIHIMLALATVLSMAG
AGTGATAIGMVTQYHQVLATHQQALEKITEALKINNLRLI
TLEHQVLVIGLKVEAIEKRLYTAFAMQELGCHQNQFFCKI
PPSLWSMYNMTLNQTIWNHGNISLGNWYNQTRDLQNKF
YEIIMDIEQNNVQGKTGIQQLQKWENWMGWIGKIPQYLK
GLLGSVLGIGLGILLLLICLPTLVDCIRNCTNKILGYTVIAM
PEIDDEEVHLSVELRRNGRQCGISEKEEE

SEQ ID NO: 415
MAEGGFTQNQQWIGPEEAEELLDFDIAVQMNEEGPLNPG
VNPFRVPGITSQEKDDYCKVLQTKLQELKNEVKEVKIEEG
NAGKFRRARYLRYSDENVLSIVYLLIGYLRYLIDHRSLGSL
RHDIDIETPQEEHYNNSEKGTTLNTKYGRRCCLSTFIMYL
VLFAGVGLWLGARAQVVWRLPPLVVPVDDTEIIFWDCW
APEEPACQDFLGTMIYLKANVNISIQEGPTLGNWAREIWS
TLFKKATRQCRRGRIWKRWNETITGPLGCATNTCYNISVV
VPDYQCYVDRVDTWLQGKVNISLCLTGGKMLYNKETRQ
LSYCTDPLQIPLINYTFGPNQTCMWNTSLIKDSEIPKCGW
WNQVAYYNACKWEEANVTFQCQRTQSQSGSWIRTISSW
KQRNRWEWRPDFESEKVKISLQCNSTKNLTFAMRSSSDY
YDVQGAWIEFGCHRNKSKKYSEARFRIRCKWNEGKNISLI
DTCGTNPNVTGANPVDCTMKANTMYNCSLQDSFTMKIE
DLIVHFNMTKAVEMYNIAGNWSCTSDLPKGWGYMNCNC
TNGTDNSETKMTCPENQGILRNWYNPVAGLRQALIKYQV
VKQPEYLIVPEEVMQYKFKQKRAAIHIMLALATVLSMAG
AGTGATAIGMVTQYHQVLATHQQALEKITEALKINNLRLI
TLEHQVLVIGLKVEAIEKFRYTAFAMQELGCHQNQFFCKI
PPSLWSMYNMTLNQTIWNHGNISLGNWYNQTRDLQNKF
YEIIMDIEQNNVQGKTGIQQLQKWENWMGWIGKIPQYLK
GLLGSVLGIGLGILLLLICLPTLVDCIRNCTNKILGYTVIAM
PEIDDEEVHLSVELRRNGRQCGISEKEEE

SEQ ID NO: 416
MAEGGFTQNQQWIGPEEAEELLDFDIAVQMNEEGPLNPG
VNPFRVPGITSQEKDDYCKILQTKLRELKNEVKEVKIEEG

-continued

NAGKLRRARYLRYSDENVLSIVYLLIGYLRYLIDHRSLGS
LRHDIDIETPQEEHYNNSEKGTTLNIKYEGRCCLSTFIMHLI
LFAGVGIWLGARAQVVWRLPPLVVPVDDTEMIFWDCWA
PEEPACQDFLGTMIHLKANVNISIQEGPTLGNWAREIWST
LFKKATRQCRRGKIWRRWNETITGPLGCANNTCYNISVV
VPDYQCYVDRVDTWLQGKVNISLCLTGGKMLYNKETRQ
LSYCTDPLQIPLINYTFGPNQTCMWNASLIKDSEIPKCGW
WNQAAYYNACKWEEANVTFQCHRTQSQSGSWIRTISSW
RQRNRWEWRPDFESEKVKISLQCNSTKNLTFAMRSSSDY
YDVQGAWIEFGCHRKKSNKHSEARFRIRCTWNEGNNISLI
DTCGTNPNVTGANPVDCTMKANVMYNCTLQDSFTMKIE
DLIVHFNMTKAVEMYNIAGNWSCTSDLPKGWGYMNCNC
TNGTDNTKMTCPKNQGILRNWYNPVAGLRQALIKYQVV
KQPEYLIVPEEVMQYKVKQKRAAIHIMLALATVLSMAGA
GTGATAIGMVTQYHQVLATHQQALDKITEALKINNLRLIT
LEHQVLVIGLKVEAIEKRLYTAFAMQELGCNQNQFFCKIP
PSLWSMYNMTLNQTIWNHGNISLGNWYNQTKDLQNKFY
EIIMDIEQNNVQGKTGIQQLQKWENWVGWIGKIPQYLKG
LLGSVLGIGLGILLLLICLPTLVDCIRSCTNRILGYTVIAMPE
IDDEEVHLSVELRRNGRQCGISEKEEE

SEQ ID NO: 417
MAEGGFTQNQQWIGPEEAEELLDFDIAVQMNEEGPLNPG
VNPFRVPGITSQEKDDYCKILQTKLRELKNEVKEVKIEEG
NAGKLRRARYLRYSDENVLSIVYLLIGYLRYLIDHRSLGS
LRHDIDIETPQEEHYNNSEKGTTLNIKYEGRCCLSTFIMHLI
LFAGVGIWLGARAQVVWRLPPLVVPVDDTEMIFWDCWA
PEEPACQDFLGTMIHLKANVNISIQEGPTLGNWAREIWST
LFKKATRQCRRGKIWRRWNETITGPLGCANNTCYNISVV
VPDYQCYVDRVDTWLQGKVNISLCLTGGKMLYNKETRQ
LSYCTDPLQIPLINYTFGPNQTCMWNASLIKDSEIPKCGW
WNQAAYYNACKWEEANVTFQCHRTQSQSGSWIRTISSW
RQRNRWEWRPDFESEKVKISLQCNSTKNLTFAMRSSSDY
YDVQGAWIEFGCHRKKSNKHSEARFRIRCTWNEGNNISLI
DTCGTNPNVTGANPVDCTMKANVMYNCTLQDSFTMKIE
DLIVHFNMTKAVEMYNIAGNWSCTSDLPKGWGYMNCNC
TNGTDNTKMTCPKNQGILRNWYNPVAGLRQALIKYQVV
KQPEYLIVPEEVMQYKVKQKRAAIHIMLALATVLSMAGA
GTGATAIGMVTQYHQVLATHQQALDKITEALKINNLRLIT
LEHQVLVIGLKVEAIEKFRYTAFAMQELGCNQNQFFCKIP
PSLWSMYNMTLNQTIWNHGNISLGNWYNQTKDLQNKFY
EIIMDIEQNNVQGKTGIQQLQKWENWVGWIGKIPQYLKG
LLGSVLGIGLGILLLLICLPTLVDCIRSCTNRILGYTVIAMPE
IDDEEVHLSVELRRNGRQCGISEKEEE

SEQ ID NO: 418
MADGGFSQNQQWIGPEEAEKSLDFDIATQMNEEGPLNPG
VNPFRVPGITPQEKEDYCKILQTRLQELKNELKEVKVEQR
NAGKFRRTRFLRYSDENVLSIVYLLIGYLRYLIDRRSLGSL
RHDIDIKIPQEEHYNNSAKDTTLNIKYERRCCIGTFIMYLIL
FAGIGIWFGAKAQVVWRLPPLVVPVEESEIIFWDCWAPEE
PACQDFLGAMIHLKANTNISIQEGPTLGNWAREIWSTLFK
KATKQCRKGGIWTKWKETITGPLGCANNTCYNISVVVPD
YQCYVDRVDTWLQGKVNISLCLTGGKMLFNKETKQLSY
CTDPLQIPLINYTFGPNQTCMWNTSQIQDSEIPKCGWWNQ
IAYYNSCQWEKTDVKFHCQRTQSQPGSWRRAISSWRQRN
RWEWRPDFESKKVKVSLKCNSTKNLTFAMRSSGDYGEV
TGAWIEFGCHRNKSKLHTEARFRIRCKWNEGNNISLIDTC
GTNPNVAEANPVDCTMKANTMYNCSLQDSFTMKIEDLIV
HFNMTKAVEMYNIAGNWSCTSDLPKGWGYMNCNCTNG
TTSNGIKMACPKQQGILRNWYNPVAGLRQALIKYQVVKQ
PEYLIVPEEVLQYKFKQKRAAIHIMLALATVLSMAGAGTG
ATAIGVVTQYHQVLATHQQALDKITEALKINNLRLITLEH
QVLVIGLKVEAIEKRLYTAFAMQELGCNQNQFFCKIPLNL
WNMYNMTLNQTIWNHGNISLGNWYNQTRDLQNKFYEII
MDIEQNNVQGHTGIQQLQKWENWVGWIGKIPQYLKGLIG
SVLGIGLGILLLLICLPTLVDCIRSCTNKMLGYTVIAMPEIG
DEGVHLAMELRRNGRQCGISEKEEE

SEQ ID NO: 419
MADGGFSQNQQWIGPEEAEKSLDFDIATQMNEEGPLNPG
VNPFRVPGITPQEKEDYCKILQTRLQELKNELKEVKVEQR
NAGKFRRTRFLRYSDENVLSIVYLLIGYLRYLIDRRSLGSL
RHDIDIKIPQEEHYNNSAKDTTLNIKYERRCCIGTFIMYLIL
FAGIGIWFGAKAQVVWRLPPLVVPVEESEIIFWDCWAPEE
PACQDFLGAMIHLKANTNISIQEGPTLGNWAREIWSTLFK
KATKQCRKGGIWTKWKETITGPLGCANNTCYNISVVVPD
YQCYVDRVDTWLQGKVNISLCLTGGKMLFNKETKQLSY
CTDPLQIPLINYTFGPNQTCMWNTSQIQDSEIPKCGWWNQ
IAYYNSCQWEKTDVKFHCQRTQSQPGSWRRAISSWRQRN
RWEWRPDFESKKVKVSLKCNSTKNLTFAMRSSGDYGEV
TGAWIEFGCHRNKSKLHTEARFRIRCKWNEGNNISLIDTC
GTNPNVAEANPVDCTMKANTMYNCSLQDSFTMKIEDLIV
HFNMTKAVEMYNIAGNWSCTSDLPKGWGYMNCNCTNG
TTSNGIKMACPKQQGILRNWYNPVAGLRQALIKYQVVKQ

-continued

```
PEYLIVPEEVLQYKFKQKRAAIHIMLALATVLSMAGAGTG

ATAIGVVTQYHQVLATHQQALDKITEALKINNLRLITLEH

QVLVIGLKVEAIEKFRYTAFAMQELGCNQNQFFCKIPLNL

WNMYNMTLNQTIWNHGNISLGNWYNQTRDLQNKFYEII

MDIEQNNVQGHTGIQQLQKWENWVGWIGKIPQYLKGLIG

SVLGIGLGILLLLICLPTLVDCIRSCTNKMLGYTVIAMPEIG

DEGVHLAMELRRNGRQCGISEKEEE
```

The invention also encompasses the variants of the above sequences, harbouring the above mentioned mutations, and conferring to said variant a decrease of immunosuppressive properties, a substantial absence of immunosuppressive properties or an absence of immunosuppressive properties.

Advantageously: the mutated feline lentiviral proteins are:

1—SEQ ID NO: 5, SEQ ID NO: 317 to 342 and SEQ ID NO: 374 to 419; these mutated ENV proteins having decreased immunosuppressive properties, substantially no immunosuppressive properties or no immunosuppressive properties.

advantageously,

2—SEQ ID NO: 5, SEQ ID NO: 317 to 342 and SEQ ID NO: 374 to 419; these mutated ENV proteins having decreased immunosuppressive properties, substantially no immunosuppressive properties or no immunosuppressive properties, and being highly expressed at the plasma membrane, more advantageously, 3—SEQ ID NO: 5, SEQ ID NO: 317 to 342, and SEQ ID NO: 374 to 419; these mutated ENV proteins having decreased immunosuppressive properties, substantially no immunosuppressive properties or no immunosuppressive properties, being highly expressed at the plasma membrane and possessing a medium or high fusogenic activity.

As mentioned above "possessing a medium or high fusogenic activity" means that when the ENV proteins are expressed at a cell plasma membrane, by using appropriate expression vectors the fusogenic activity of said proteins as measured by quantitating the ENV-mediated cell-cell fusion (see Materials and Methods) is:

either at a level comparable or higher to the ability of the wild type ENV, i.e. high ability
or at a lower level compared to the ability of the wild type ENV, i.e. medium or low ability.

In another aspect, the invention relates to a pharmaceutical composition comprising as active substance a nucleic acid molecule coding for a mutated feline lentiviral ENV protein, or a fragment of said mutated feline lentiviral ENV protein, as defined above.

In a particular embodiment, the invention concerns a pharmaceutical as defined above, wherein said nucleic acid molecule is contained in a vector, said vector comprising means allowing the expression of the mutated feline lentiviral ENV protein, or a fragment of said mutated feline lentiviral ENV protein, as defined above.

In another embodiment, the invention relates to a pharmaceutical composition as defined above, wherein said nucleic acid molecule is comprised in a vector, said nucleic acid molecule being placed under the control of sequences that allow the expression of said mutated lentiviral ENV protein, or variant of said protein, or fragments thereof.

In another embodiment, the invention relates to a pharmaceutical composition, as defined above, in particular as a vaccine, comprising a DNA molecule coding for said mutated feline lentiviral ENV protein or a fragment thereof.

DNA vaccines expressing ENV proteins can be produced as described in Bellier et al. (*Vaccine*, 2009, 27(42):5772-80).

In another embodiment, the invention concerns a pharmaceutical as defined above, wherein said vector is chosen among a canarypox vector, a pox vector, a fowlpox, an adenoviral vector, a lentiviral vector, a measles vector, a Sendaï virus vector, a Cytomegalovirus vector or a Modified Vaccinia Ankara vector.

In another embodiment, the invention concerns a pharmaceutical as defined above, comprising at least one nucleic acid molecule coding for a GAG protein and/or a PRO protein and/or a POL protein of a feline lentivirus, said lentivirus being preferably of the same origin as the mutated lentiviral ENV protein.

GAG expression will produce virus-like particles (VLPs) which are particularly advantageous for a vaccine, in particular if the ENV protein is associated with the VLP (Guerbois et al., *Virology*, 2009, 388:191-203).

In another embodiment, the invention concerns a pharmaceutical as defined above, wherein said nucleic acid molecule coding for a mutated feline lentiviral ENV protein, or a fragment of said mutated feline lentiviral ENV protein, is contained in the same vector as the one which also contains said at least one nucleic acid molecule coding for a GAG protein and/or a PRO protein and/or a POL protein.

In another embodiment, the invention concerns a pharmaceutical as defined above, wherein said nucleic acid molecule coding for a mutated feline lentiviral ENV protein, or a fragment of said mutated feline lentiviral ENV protein, is contained in the same vector as the one which also contains all said at least one nucleic acid molecule coding for a GAG protein and/or a PRO protein and/or a POL protein.

In another embodiment, the invention concerns a pharmaceutical as defined above, wherein said nucleic acid molecule coding for a mutated feline lentiviral ENV protein, or a fragment of said mutated feline lentiviral ENV protein, is contained in a vector which is different from the at least one vector containing said at least one nucleic acid molecule coding for a GAG protein and/or a PRO protein and/or a POL protein.

In another embodiment, the invention concerns a pharmaceutical as defined above, wherein said nucleic acid molecule coding for a mutated feline lentiviral ENV protein, or a fragment of said mutated feline lentiviral ENV protein, said nucleic acid molecule coding for a GAG protein, said nucleic acid molecule coding for a PRO protein and said nucleic acid molecule coding for a POL protein, are all contained in vectors which are different from each other.

In another embodiment, the invention concerns a pharmaceutical as defined above, comprising at least one nucleic acid molecule coding for a GAG protein of a feline lentivirus, said lentivirus being preferably of the same origin as the mutated lentiviral ENV protein.

In another embodiment, the invention concerns a pharmaceutical as defined above, wherein said nucleic acid molecule coding for a mutated feline lentiviral ENV protein, or a fragment of said mutated feline lentiviral ENV protein, is contained in the same vector as the one which also contains said at least one nucleic acid molecule coding for a GAG protein.

In another embodiment, the invention concerns a pharmaceutical as defined above, wherein said nucleic acid molecule coding for a mutated feline lentiviral ENV protein, or a fragment of said mutated feline lentiviral ENV protein, is contained in the same vector as the one which also contains a nucleic acid molecule coding for a GAG protein.

In another embodiment, the invention concerns a pharmaceutical as defined above, wherein said nucleic acid molecule coding for a mutated feline lentiviral ENV protein, or a fragment of said mutated feline lentiviral ENV protein, is contained in the same vector as the one which also contains a nucleic acid molecule coding for a GAG protein, said vector being preferably a canary pox vector (Poulet et al., *Veterinary Record,* 2003, 153(5):141-145; Vaccari et al., *Expert Review of Vaccines,* 2010, Vol. 9, No 9: 997-1005).

In another embodiment, the invention concerns a pharmaceutical as defined above, wherein said nucleic acid molecule coding for a mutated feline lentiviral ENV protein, or a fragment of said mutated feline lentiviral ENV protein, is contained in a vector which is different from the at least one vector containing said at least one nucleic acid molecule coding for a GAG protein.

In another embodiment, the invention concerns a pharmaceutical as defined above, wherein said nucleic acid molecule coding for a mutated feline lentiviral ENV protein, or a fragment of said mutated feline lentiviral ENV protein, and said nucleic acid molecule coding for a GAG protein are contained in vectors which are different from each other.

In another aspect, the invention concerns a pharmaceutical composition as defined above, in association with at least one antiviral compound, preferably for a simultaneous, separated or sequential use.

The composition according to the invention can also be used in combination with the antiviral compositions listed in Table 1 below:

TABLE 1

| Examples of antiviral compounds. | |
|---|---|
| Intelence ® (TMC 125/etravirine) Tibotec - | Non-nucleoside reverse transcriptase inhibitor |
| Agenerase ®(APV/amprenavir) GSK - | Protease inhibitor |
| Aptivus ®(TPV/tipranavir) Boehringer - | Protease inhibitor |
| Crixivan ®(IDV/indinavir) MSD - | Protease inhibitor |
| Invirase ®(SQV/saquinavir) Roche - | Protease inhibitor |
| Kaletra ®(LPV.r/lopinavir + ritonavir) Abbott | Protease inhibitor |
| Norvir ®(ritonavir) Abbott - | Protease inhibitor |
| Prezista ®(TMC 114/darunavir) Tibotec/Janssen-Cilag - | Protease inhibitor |
| Reyataz ®(ATZ/atazanavir) BMS - | Protease inhibitor |
| Telzir ®(APV/fosamprenavir) GSK - | Protease inhibitor |
| Viracept ®(nelfinavir) Roche - | Protease inhibitor |
| Fuzeon ®(T20/enfuvirtide) Roche - | Fusion inhibitor |
| Celsentri ®(maraviroc) Pfizer - | Entry inhibitor |
| Isentress ®(MK 0518/raltegravir) Merck - | Integrase inhibitor |
| Rescriptor ®(delavirdine) Agouron - | Non-nucleoside reverse transcriptase inhibitor |
| Sustiva ®(EFV/efavirenz) BMS - | Non-nucleoside reverse transcriptase inhibitor |
| Viramune ®(nevirapine) Boehringer - | Non-nucleoside reverse transcriptase inhibitor |
| Combivir ®(Retrovir ® + Epivir ®) GSK - | Nucleoside reverse transcriptase inhibitor |
| Emtriva ®(FTC, emtricitabine) Gilead - | Nucleoside reverse transcriptase inhibitor |
| Epivir ®(3TC, lamivudine) GSK - | Nucleoside reverse transcriptase inhibitor |

TABLE 1-continued

| Examples of antiviral compounds. | |
|---|---|
| Kivexa ®(Ziagen ® + Epivir ®) GSK - | Nucleoside reverse transcriptase inhibitor |
| Retrovir ®(AZT/zidovudine) QSK - | Nucleoside reverse transcriptase inhibitor |
| Trizivir ®(Retrovir ® + Epivir ® + Ziagen ®) GSK - | Nucleoside reverse transcriptase inhibitor |
| Videx ®(ddI/didanosine) BMS - | Nucleoside reverse transcriptase inhibitor |
| Viread ®(TDF/tenofovir) Gilead - | Nucleoside reverse transcriptase inhibitor |
| Zerit ®(d4T/stavudine) BMS - | Nucleoside reverse transcriptase inhibitor |
| Ziagen ®(ABC/abacavir) GSK - | Nucleoside reverse transcriptase inhibitor |
| Truvada ®(Emtriva ® + Viread ®) Gilead - | Nucleoside reverse transcriptase inhibitor |
| Atripla ®(Sustiva ® + Emtriva ® + Viread ®) BMS/GILEAD | Nucleoside and non-nucleoside reverse transcriptase inhibitor |

In another aspect, the invention concerns a pharmaceutical composition as defined above, for its use for stimulating an immune response in a host organism.

In another aspect, the invention concerns a pharmaceutical composition as defined above, for its use for the prevention or the treatment of lentiviral infection, preferably FIV infection.

In another aspect, the invention concerns a pharmaceutical composition as defined above, for its use as a vaccine, in particular against FIV infection.

As mentioned above, the pharmaceutical composition according to the invention encompasses a vaccine, comprising as active substance, a protein as defined above, or a nucleic acid molecule as defined above, or a vector as defined above, or a combination thereof.

In a particular embodiment, the pharmaceutical composition according to the invention encompasses a vaccine as defined above, comprising a nucleic acid coding for a GAG protein as defined above and a nucleic acid coding for a mutated ENV protein as defined above, which are contained in a same vector, said same vector being preferably a canary pox vector.

In a particular embodiment, the pharmaceutical composition according to the invention encompasses a vaccine, comprising a GAG protein as defined above and a mutated ENV protein as defined above.

In a particular embodiment, the pharmaceutical composition according to the invention encompasses a vaccine, comprising a GAG protein as defined above and a mutated ENV protein as defined above which are associated to at least one adjuvant.

As examples of adjuvants, a non limitative list is given below:

- Aluminum-based compounds such as aluminum phosphate and aluminum hydroxide.
- Immunostimulatory adjuvants like CpG, MPL and QS21 orMF59 which is a squalene oil-in water emulsions.
- Freunds incomplete adjuvant (FIA) or Freund's complete adjuvant (FCA), can also be used.
- Calcium phosphate in particular orthophosphates, metaphosphates or pyrophosphates and occasionally hydrogen or hydroxide ions.
- Muramyl dipeptide (N-Acetyl muramyl-L-alanine-D-isoglutamine, MDP) and its synthetic analogs such as muramyl tripeptide phosphatidylethanolamine MTPPTdEtn),
- Trehalose-6,6'-dimycolate, Saponins (Triterpenoid glycosides) like QS-21
Stearyl Tyrosine (octadecyl ester hydrochloride salt of tyrosine)
Polysaccharides like:
- Chitosan:
- Inulin:
- Beta-Glucans
- Lipo-Polysaccharides or endotoxin
- MGN-3*Actinidia eriantha* (AEPS):
- Eldexomer:
- CpG ODN Liposomes like
- Dehydration-rehydration liposome vesicles (DRVs)
- Cytotoxic T lymphocyte (CTL)
- CAF01
- Liposomes containing lipid A (LA)

Lipid Polysine Core Peptides (LCP)
Cytokine like GM-CSF, IL-2, IL-12 or IL-15
Lipid A and Monophosphoryl Lipid A (MPL)
Lipopeptide which are molecules consisting of lipid connected to a peptide. (They are derived from the lipoprotein of bacterial cell wall.)
Exogenous Immunostimulatory Adjuvants which are compounds, or proteins that are not found in the human body like:
- Proteosomes in particular Multiple Antigenic Peptides (MAP) or Exogenous Toxins.

Suitably, the total amount of mutated lentiviral ENV protein in a single dose of the immunogenic composition is 1-500 μg and/or the total amount of unfused polypeptides in a single dose of the immunogenic composition is 1-500 μg. In one embodiment, the total amount of all antigens in a single dose of the immunogenic composition is 1-1000 μg, 10-500 μg, 100-200 μg, or around 100 μg.

The amount of mutated feline lentiviral ENV protein in a dose of the immunogenic composition is selected as an amount which induces an immune response without significant, adverse side effects in typical recipients. Such amount will vary depending upon which specific immunogen is employed and the dosing or vaccination regimen that is selected. An optimal amount for a particular immunogenic composition can be ascertained by standard studies involving observation of relevant immune responses in infected animals.

Administration of the pharmaceutical composition can take the form of one or of more than one individual dose, for example as repeat doses of the same polypeptide containing composition, or in a heterologous "prime-boost" vaccination regime, including proteins and vectors. In one embodiment, the immunogenic composition of the invention is initially administered to a subject as two or three doses, wherein the doses are separated by a period of two weeks to three months, preferably one month. Conveniently, the composition is administered to an animal (for instance as a booster) every 6-24, or 9-18 months, for instance annually. For instance, the composition is administered to an animal (for instance as a booster) at six month or 1 year intervals. Suitably in this respect, subsequent administrations of the composition to the animal boost the immune response of earlier administrations of the composition to the same animal.

In an embodiment, the immunogenic composition of the invention is used as part of a prime-boost regimen for use in the treatment or prevention of disease or infection by FIV strains from one or more clades different from the one or more FIV clades in the immunogenic composition. Conveniently, the composition is the priming dose. Alternatively, the composition is the boosting dose.

Suitably, two or more priming and/or boosting doses are administered. A heterologous prime-boost regime uses administration of different forms of immunogenic composition or vaccine in the prime and the boost, each of which can itself include two or more administrations. The priming composition and the boosting composition will have at least one antigen in common, although it is not necessarily an identical form of the antigen, it can be a different form of the same antigen.

Prime boost immunisations according to the invention can be homologous prime-boost regimes or heterologous prime-boost regimes. Homologous prime-boost regimes utilize the same composition for prime and boost, for instance the immunogenic composition of the invention. Heterologous prime-boost regimes can be performed with a combination of protein and DNA-based formulations. Such a strategy is considered to be effective in inducing broad immune responses. Adjuvanted protein vaccines induce mainly antibodies and CD4+ T cell immune responses, while delivery of DNA as a plasmid or a recombinant vector induces strong CD8+ T cell responses.

Thus, the combination of protein and DNA vaccination can provide for a wide variety of immune responses. This is particularly relevant in the context of FIV, since neutralizing antibodies, CD4+ T cells and CD8+ T cells are thought to be important for the immune defense against FIV.

The invention also relates to a method for treating animals afflicted by pathologies related to lentiviral infections, comprising the administration to an animal in a need thereof of a pharmaceutically efficient amount of the pharmaceutical composition as defined above.

The invention also relates to a pharmaceutical composition as defined above, as a vaccine, for its use for the prevention or the treatment of FIV infection, or pathologies related to feline immunodeficiency.

In another aspect, the invention relates to a pharmaceutical composition comprising as active substance:

an isolated non naturally occurring mutated feline lentiviral ENV having a decreased immunosuppressive activity, substantially no immunosuppressive activity or no immunosuppressive activity, said mutated feline lentiviral ENV resulting from mutation of the transmembrane subunit (TM) of a wild type feline lentiviral ENV protein, the transmembrane subunit comprising an immunosuppressive domain (ISU) comprising the following amino acid sequence:

```
                                    (SEQ ID NO: 343)
        A-[I/M/T/L]-E-K-F-L-Y-T-A,
``` wherein the amino acids at the positions chosen among
the position 3 of SEQ ID NO: 343, and/or
the position 4 of SEQ ID NO: 343 and/or
the position 5 of SEQ ID NO: 343, and/or
the position 6 of SEQ ID NO: 343, and/or
the position 7 of SEQ ID NO: 343,
are:
either deleted,
or substituted by another amino acid such that
- the amino acid residue at position 3 of SEQ ID NO: 1 is substituted by A, F, G, L, R, C, D, H, I, K, M, N, P, Q, S, T, V, W or Y, and/or
- the amino acid residue at position 4 of SEQ ID NO: 1 is substituted by A, F, G, L, R, C, D, E, H, I, M, N, P, Q, S, T, V, W or Y, and/or the amino acid residue at position 5 of SEQ ID NO: 1 is substituted by A, G, L, R, C, D, E, H, I, K, M, N, P, Q, S, T, V, W or Y, and/or the amino acid residue at position 6 of SEQ ID NO: 1 is substituted by A, F, G, R, C, D, E, H, I, K, M, N, P, Q, S, T, V, W or Y, and/or the amino acid residue at position 7 of SEQ ID NO: 1 is substituted by A, F, G, L, R, C, D, E, H, I, K, M, N, P, Q, S, T, V or W.

In another aspect, the invention relates to a method to obtain the active substance of a pharmaceutical composition, as defined above, consisting in modifying the immunosuppressive property of:

a wild-type feline lentiviral ENV protein, or a fragment of said wild-type feline lentiviral ENV protein, said fragment comprising at least 40 amino acids, in particular at least 60 amino acids, said ENV protein or fragment thereof presenting a transmembrane subunit (TM) comprising an immunosuppressive domain (ISU) containing the following amino acid sequence:

$$\text{A-[I/M/T/L]-}X_A\text{-}X_B\text{-}X_C\text{-}X_D\text{-}X_E\text{-T-A,} \quad \text{(SEQ ID NO: 344)}$$

wherein $X_A$ is C, D, E, H, I, K, M, N, P, Q, S, T, V, W or Y, and
$X_B$ is C, D, E, H, I, K, M, N, P, Q, S, T, V, W or Y, and
$X_C$ is F, C, D, E, H, I, K, M, N, P, Q, S, T, V, W or Y, and
$X_D$ is L, C, D, E, H, I, K, M, N, P, Q, S, T, V, W or Y, and
$X_E$ is C, D, E, H, I, K, M, N, P, Q, 5, T, V, W or Y, said method comprising a step of introduction of at least one mutation of $X_A$ and/or $X_B$ and/or $X_C$ and/or $X_D$ and/or $X_E$, to obtain:

an isolated mutated feline lentiviral ENV protein having a decreased immunosuppressive activity, substantially no immunosuppressive activity or no immunosuppressive activity, said mutated feline lentiviral ENV protein having at least 70% identity, preferably at least 80% identity, to one sequence SEQ ID NO: 5, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted.

In a particular embodiment, the invention concerns a method to obtain the active substance of a pharmaceutical composition, as defined above, consisting in modifying the immunosuppressive property of a wild-type feline lentiviral ENV protein, or a fragment of said wild-type feline lentiviral ENV protein, said fragment comprising at least 40 amino acids, in particular at least 60 amino acids, said ENV protein or fragment thereof presenting a transmembrane subunit (TM) comprising an immunosuppressive domain (ISU) containing the following amino acid sequence:

$$\text{[V/I]-[E/R]-A-[I/M/T/L]-}X_A\text{-}X_B\text{-}X_C\text{-}X_D\text{-}X_E\text{-T-A-[F/L]-A-M,} \quad \text{(SEQ ID NO: 345)}$$

wherein $X_A$ is C, D, E, H, I, K, M, N, P, Q, S, T, V, W or Y, and
$X_B$ is C, D, E, H, I, K, M, N, P, Q, S, T, V, W or Y, and
$X_C$ is F, C, D, E, H, I, K, M, N, P, Q, S, T, V, W or Y, and
$X_D$ is L, C, D, E, H, I, K, M, N, P, Q, S, T, V, W or Y, and
$X_E$ is C, D, E, H, I, K, M, N, P, Q, 5, T, V, W or Y, said method comprising a step of introduction of at least one mutation of $X_A$ and/or $X_B$ and/or $X_C$ and/or $X_D$ and/or $X_E$, to obtain:

an isolated mutated feline lentiviral ENV protein having a decreased immunosuppressive activity, substantially no immunosuppressive activity or no immunosuppressive activity, said mutated feline lentiviral ENV protein having at least 70% identity, preferably at least 80% identity, to one sequence SEQ ID NO: 5, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{[V/I]-[E/R]-A-[I/M/T/L]-}X_1\text{-}X_2\text{-}X_3\text{-}X_4\text{-}X_5\text{-T-A-[F/L]-A-M,} \quad \text{(SEQ ID NO: 3)}$$

wherein $X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted.

In another embodiment, the invention concerns a method to obtain the active substance of a pharmaceutical composition, as defined above, consisting in modifying the immunosuppressive property of a wild-type feline lentiviral ENV protein, or a fragment of said wild-type feline lentiviral ENV protein, said fragment comprising at least 40 amino acids, in particular at least 60 amino acids, said ENV protein or fragment thereof presenting a transmembrane subunit (TM) comprising an immunosuppressive domain (ISU) containing the following amino acid sequence:

$$\text{A-[I/M/T/L]-E-K-[F/P]-[L/V/I]-Y-T-A,} \quad \text{(SEQ ID NO: 346)}$$

said method comprising a step of introduction of at least one mutation of E in position 3 and/or K in position 4 and/or [F/P] in position 5 and/or [L/V/I] in position 6 and/or Y in position 7, to obtain:

an isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

(SEQ ID NO: 1)
A-[I/M/T/L]-$X_1$-$X_2$-$X_3$-$X_4$-$X_5$-T-A, wherein
$X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted.

In another embodiment, the invention concerns a method to obtain the active substance of a pharmaceutical composition, as defined above, consisting in modifying the immunosuppressive property of a wild-type feline lentiviral ENV protein, or a fragment of said wild-type feline lentiviral ENV protein, said fragment comprising at least 40 amino acids, in particular at least 60 amino acids, said ENV protein or fragment thereof presenting a transmembrane subunit (TM) comprising an immunosuppressive domain (ISU) containing the following amino acid sequence:

(SEQ ID NO: 347)
[V/I]-[E/R]-A-[I/M/T/L]-E-K-[F/P]-[L/V/I]-Y-T-A-[F/L]-A-M, said method comprising a step of introduction of at least one mutation of E in position 3 and/or K in position 4 and/or [F/P] in position 5 and/or [L/V/I] in position 6 and/or Y in position 7, to obtain:

an isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

(SEQ ID NO: 3)
[V/I]-[E/R]-A-[I/M/T/L]-$X_1$-$X_2$-$X_3$-$X_4$-$X_5$-T-A-[F/L]-A-M, wherein
$X_1$ is any amino acid different from E or deleted, and/or
$X_2$ is any amino acid different from K or deleted, and/or
$X_3$ is any amino acid different from F or deleted, and/or
$X_4$ is any amino acid different from L or deleted, and/or
$X_5$ is any amino acid different from Y or deleted.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

(SEQ ID NO: 1)
A-[I/M/T/L]-$X_1$-$X_2$-$X_3$-$X_4$-$X_5$-T-A, wherein
$X_1$ is any amino acid different from E or deleted, and $X_2$, $X_3$, $X_4$ and $X_5$ are any amino acid, or
$X_2$ is any amino acid different from K or deleted, and $X_1$, $X_3$, $X_4$ and $X_5$ are any amino acid, or
$X_3$ is any amino acid different from F or deleted, and $X_1$, $X_2$, $X_4$ and $X_5$ are any amino acid, or
$X_4$ is any amino acid different from L or deleted, and $X_1$, $X_2$, $X_3$ and $X_5$ are any amino acid, or
$X_5$ is any amino acid different from Y or deleted, and $X_1$, $X_2$, $X_3$ and $X_4$ are any amino acid, or
$X_1$ is any amino acid different from E or deleted, $X_2$ is any amino acid different from K or deleted, and $X_3$, $X_4$ and $X_5$ are any amino acid, or
$X_1$ is any amino acid different from E or deleted, $X_3$ is any amino acid different from F or deleted, and $X_2$, $X_4$ and $X_5$ are any amino acid, or
$X_1$ is any amino acid different from E or deleted, $X_4$ is any amino acid different from L or deleted, and $X_2$, $X_3$ and $X_5$ are any amino acid, or
$X_1$ is any amino acid different from E or deleted, $X_5$ is any amino acid different from Y or deleted, and $X_2$, $X_3$ and $X_4$ are any amino acid, or
$X_2$ is any amino acid different from K or deleted, $X_3$ is any amino acid different from F or deleted, and $X_1$, $X_4$ and $X_5$ are any amino acid, or
$X_2$ is any amino acid different from K or deleted, $X_4$ is any amino acid different from L or deleted, and $X_2$, $X_4$ and $X_5$ are any amino acid, or
$X_2$ is any amino acid different from K or deleted, $X_5$ is any amino acid different from Y or deleted, and $X_2$, $X_3$ and $X_4$ are any amino acid, or
$X_3$ is any amino acid different from F or deleted, $X_4$ is any amino acid different from L or deleted, and $X_2$, $X_4$ and $X_5$ are any amino acid, or
$X_3$ is any amino acid different from F or deleted, $X_5$ is any amino acid different from Y or deleted, and $X_2$, $X_3$ and $X_4$ are any amino acid, or
$X_4$ is any amino acid different from L or deleted, $X_5$ is any amino acid different from Y or deleted, and $X_2$, $X_4$ and $X_5$ are any amino acid, or
$X_1$ is any amino acid different from E or deleted, $X_2$ is any amino acid different from K or deleted, $X_3$ is any amino acid different from F or deleted, and $X_4$ and $X_5$ are any amino acid, or X₁ is any amino acid different from E or deleted, X₂ is any amino acid different from K or deleted, X₄ is any amino acid different from L or deleted, and X₃ and X₅ are any amino acid, or X₁ is any amino acid different from E or deleted, X₂ is any amino acid different from K or deleted, X₅ is any amino acid different from Y or deleted, and X₃ and X₄ are any amino acid, or X₁ is any amino acid different from E or deleted, X₃ is any amino acid different from F or deleted, X₄ is any amino acid different from L or deleted, and X₂ and X₅ are any amino acid, or X₁ is any amino acid different from E or deleted, X₃ is any amino acid different from F or deleted, X₅ is any amino acid different from Y or deleted, and X₂ and X₄ are any amino acid, or X₁ is any amino acid different from E or deleted, X₄ is any amino acid different from L or deleted, X₅ is any amino acid different from Y or deleted, and X₂ and X₃ are any amino acid, or X₂ is any amino acid different from K or deleted, X₃ is any amino acid different from F or deleted, X₄ is any amino acid different from L or deleted, and X₁ and X₅ are any amino acid, or X₂ is any amino acid different from K or deleted, X₃ is any amino acid different from F or deleted, X₅ is any amino acid different from Y or deleted, and X₁ and X₄ are any amino acid, or X₂ is any amino acid different from K or deleted, X₄ is any amino acid different from L or deleted, X₅ is any amino acid different from Y or deleted, and X₁ and X₃ are any amino acid, or X₃ is any amino acid different from F or deleted, X₄ is any amino acid different from L or deleted, X₅ is any amino acid different from Y or deleted, and X₁ and X₂ are any amino acid, or X₁ is any amino acid different from E or deleted, X₂ is any amino acid different from K or deleted, X₃ is any amino acid different from F or deleted, X₄ is any amino acid different from L or deleted, and X₅ is any amino acid, or X₁ is any amino acid different from E or deleted, X₂ is any amino acid different from K or deleted, X₃ is any amino acid different from F or deleted, X₅ is any amino acid different from Y or deleted, and X₄ is any amino acid, or X₁ is any amino acid different from E or deleted, X₂ is any amino acid different from K or deleted, X₄ is any amino acid different from L or deleted, X₅ is any amino acid different from Y or deleted, and X₃ is any amino acid, or X₁ is any amino acid different from E or deleted, X₃ is any amino acid different from F or deleted, X₄ is any amino acid different from L or deleted, X₅ is any amino acid different from Y or deleted, and X₂ is any amino acid, or X₂ is any amino acid different from K or deleted, X₃ is any amino acid different from F or deleted, X₄ is any amino acid different from L or deleted, X₅ is any amino acid different from Y or deleted and X₁ is any amino acid, or X₁ is any amino acid different from E or deleted, X₂ is any amino acid different from K or deleted, X₃ is any amino acid different from F or deleted, X₄ is any amino acid different from L or deleted and X₅ is any amino acid different from Y or deleted.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

(SEQ ID NO: 1)
A-[I/M/T/L]-X₁-X₂-X₃-X₄-X₅-T-A, wherein

X₁ is R, G, L, A, F or deleted, and/or
X₂ is R, G, L, A, F or deleted, and/or
X₃ is R, G, L, A, or deleted, and/or
X₄ is R, G, A, F or deleted, and/or
X₅ is R, G, L, A, F or deleted.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

(SEQ ID NO: 3)
[V/I]-[E/R]-A-[I/M/T/L]-X₁-X₂-X₃-X₄-X₅-T-A-[F/L]-A-M, wherein

X₁ is R, G, L, A, F or deleted, and/or
X₂ is R, G, L, A, F or deleted, and/or
X₃ is R, G, L, A, or deleted, and/or
X₄ is R, G, A, F or deleted, and/or
X₅ is R, G, L, A, F or deleted.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_1$ is R, G, L, A, F or deleted, and/or $X_2$ is G, L, F or deleted, and/or $X_3$ is R, G, L, A, or deleted, and/or $X_4$ is R, G, A, F or deleted, and/or $X_5$ is G, L, F or deleted.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_3$ is R, G, L, A or deleted, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, G, A, F or deleted, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, G, L, A or deleted, $X_4$ is R, G, A, F or deleted, and $X_1$, $X_2$, $X_5$ are A, F, G, L, R, C, D, E, H, I, K, M, N, P, Q, 5, T, V, W or Y.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_3$ is R, A or deleted, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, A or deleted, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, A or deleted, $X_4$ is R, A or deleted, and $X_1$, $X_2$, $X_5$ are A, F, G, L, R, C, D, E, H, I, K, M, N, P, Q, S, T, V, W or Y.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_3$ is R, $X_4$ is L, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_4$ is R, $X_3$ is F, C, D, E, H, I, K, M, N, P, Q, S, T, V, W or Y, and $X_1$, $X_2$, $X_5$ are A, F, G, L, R, C, D, E, H, I, K, M, N, P, Q, S, T, V, W or Y, or $X_3$ is R, $X_4$ is R, and $X_1$, $X_2$, $X_5$ are A, F, G, L, R, C, D, E, H, I, K, M, N, P, Q, S, T, V, W or Y.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-}X_1\text{-}X_2\text{-}X_3\text{-}X_4\text{-}X_5\text{-T-A,} \quad \text{(SEQ ID NO: 1)}$$

wherein $X_3$ is R, and $X_1$ is E, $X_2$ is K, $X_4$ is L, $X_5$ is Y, or $X_4$ is R, and $X_1$ is E, $X_2$ is K, $X_3$ is F, $X_5$ is Y, or $X_3$ is R, $X_4$ is R, and $X_1$ is E, $X_2$ is K, $X_5$ is Y.

In another embodiment, the invention concerns a method to obtain the active substance of a pharmaceutical composition, as defined above, wherein said isolated mutated feline lentiviral ENV protein having a decreased immunosuppressive activity, substantially no immunosuppressive activity or no immunosuppressive activity, or a fragment of said isolated mutated feline lentiviral ENV protein having a decreased immunosuppressive activity, substantially no immunosuppressive activity or no immunosuppressive activity said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-X}_1\text{-X}_2\text{-X}_3\text{-X}_4\text{-X}_5\text{-T-A,} \quad \text{(SEQ ID NO: 1)}$$

wherein $X_3$ is R, and $X_1$, $X_2$, $X_4$, $X_5$ are A, F, G, L, R, C, D, E, H, I, K, M, N, P, Q, S, T, V, W or Y.

In another embodiment, the invention concerns a method to obtain the active substance of a pharmaceutical composition, as defined above wherein said isolated mutated feline lentiviral ENV protein having a decreased immunosuppressive activity, substantially no immunosuppressive activity or no immunosuppressive activity or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-X}_1\text{-X}_2\text{-X}_3\text{-X}_4\text{-X}_5\text{-T-A,} \quad \text{(SEQ ID NO: 1)}$$

wherein $X_3$ is R, and $X_1$ is E, $X_2$ is K, $X_4$ is L, $X_5$ is Y.

In another embodiment, the invention concerns a method to obtain the active substance of a pharmaceutical composition, as defined above, consisting in modifying the immunosuppressive property of:

a wild-type feline lentiviral ENV protein, or a fragment of said wild-type feline lentiviral ENV protein, said fragment comprising at least 40 amino acids, in particular at least 60 amino acids, said ENV protein or fragment thereof presenting a transmembrane subunit (TM) comprising an immunosuppressive domain (ISU) containing the following amino acid sequence:

$$\text{A-[I/M/T/L]-X}_A\text{-X}_B\text{-X}_C\text{-X}_D\text{-X}_E\text{-T-A,} \quad \text{(SEQ ID NO: 344)}$$

wherein $X_A$ is E, and
$X_B$ is K, and
$X_C$ is F or P, and
$X_D$ is L, V or I, and
$X_E$ is Y, said method comprising a step of introduction of at least one mutation of $X_A$ and/or $X_B$ and/or $X_C$ and/or $X_D$ and/or $X_E$, to obtain:

an isolated mutated feline lentiviral ENV protein having a decreased immunosuppressive activity, substantially no immunosuppressive activity or no immunosuppressive activity, said mutated feline lentiviral ENV protein having at least 70% identity, preferably at least 80% identity, to one sequence SEQ ID NO: 5, or a fragment of said isolated mutated feline lentiviral ENV protein having a decreased immunosuppressive activity, substantially no immunosuppressive activity or no immunosuppressive activity, said fragment comprising at least 40 amino acids, in particular at least 60 amino acids, said mutated ENV protein and fragment thereof comprising a mutated immunosuppressive domain (ISU) containing the following amino sequence:

$$\text{A-[I/M/T/L]-X}_1\text{-X}_2\text{-X}_3\text{-X}_4\text{-X}_5\text{-T-A,} \quad \text{(SEQ ID NO: 1)}$$

wherein $X_1$ is any amino acid different from E, and $X_2$, $X_3$, $X_4$ and $X_5$ are any amino acid, or $X_2$ is any amino acid different from K, and $X_1$, $X_3$, $X_4$ and $X_5$ are any amino acid, or $X_3$ is any amino acid different from F, and $X_1$, $X_2$, $X_4$ and $X_5$ are any amino acid, or $X_4$ is any amino acid different from L, and $X_1$, $X_2$, $X_3$ and $X_5$ are any amino acid, or $X_5$ is any amino acid different from Y, and $X_1$, $X_2$, $X_3$ and $X_4$ are any amino acid, in particular, wherein $X_1$ is R, G, L, A or F, and $X_2$, $X_3$, $X_4$ and $X_5$ are any amino acid, or $X_2$ is R, G, L, A or F, and $X_1$, $X_3$, $X_4$ and $X_5$ are any amino acid, or $X_3$ is R, G, L or A, and $X_1$, $X_2$, $X_4$ and $X_5$ are any amino acid, or $X_4$ is R, G, A or F, and $X_1$, $X_2$, $X_3$ and $X_5$ are any amino acid, or $X_5$ is R, G, L, A or F and $X_1$, $X_2$, $X_3$ and $X_4$ are any amino acid.

In other aspect, the invention also relates to pharmaceutical compositions comprising as active substance a mutated lentiviral protein isolated from other animal lentiviruses, infecting bovine, equine, ovine or caprine animal species.

In another aspect, the invention also relates to a pharmaceutical composition comprising as active substance an isolated mutated bovine lentiviral ENV protein having a decreased immunosuppressive activity, substantially no immunosuppressive activity or no immunosuppressive activity, or a fragment thereof, said mutated bovine lentiviral ENV protein resulting from mutation of the transmembrane (TM) subunit of a wild type bovine lentiviral ENV protein, said mutated ENV protein having at least 70% identity, preferably at least 80% identity, to the sequence SEQ ID NO: 420, said mutated bovine lentiviral ENV protein or fragment thereof comprising a mutated immunosuppressive domain (ISU) containing the following amino acid sequence:

$$\text{Y-L-Z}^A_1\text{-Z}^A_2\text{-Z}^A_3\text{-Z}^A_4\text{-Z}^A_5\text{-[I/V]-[R/H],} \quad \text{(SEQ ID NO: 421)}$$

wherein, $Z^A_1$ is any amino acid different from E or deleted, and/or
$Z^A_2$ is any amino acid different from Y or F or deleted, and/or
$Z^A_3$ is any amino acid different from V or L or deleted, and/or
$Z^A_4$ is any amino acid different from E or A or deleted, and/or
$Z^A_5$ is any amino acid different from E or deleted, in association with a pharmaceutically acceptable carrier.

In another aspect, the invention also relates to a pharmaceutical composition comprising as active substance an isolated mutated bovine lentiviral ENV protein having a decreased immunosuppressive activity, substantially no immunosuppressive activity or no immunosuppressive activity, or a fragment thereof, said mutated bovine lentiviral ENV protein resulting from mutation of the transmembrane (TM) subunit of a wild type bovine lentiviral ENV protein, said mutated ENV protein having at least 70% identity, preferably at least 80% identity, to the sequence SEQ ID NO: SEQ ID NO: 420, said mutated bovine lentiviral ENV protein or fragment thereof comprising a mutated immunosuppressive domain (ISU) containing the following amino acid sequence:

$$\text{V-[S/T]-Y-L-}Z^A_1\text{-}Z^A_2\text{-}Z^A_3\text{-}Z^A_4\text{-}Z^A_5\text{-[I/V]-[R/H]-[E/Q]-[K/L/V]-Q,} \quad \text{(SEQ ID NO: 422)}$$

wherein, $Z^A_1$ is any amino acid different from E or deleted, and/or
$Z^A_2$ is any amino acid different from Y or F or deleted, and/or
$Z^A_3$ is any amino acid different from V or L or deleted, and/or
$Z^A_4$ is any amino acid different from E or A or deleted, and/or
$Z^A_5$ is any amino acid different from E or deleted, in association with a pharmaceutically acceptable carrier.

In another aspect, the invention also relates to a pharmaceutical composition comprising as active substance an isolated mutated bovine lentiviral ENV protein having a decreased immunosuppressive activity, substantially no immunosuppressive activity or no immunosuppressive activity, or a fragment thereof, said mutated bovine lentiviral ENV protein resulting from mutation of the transmembrane (TM) subunit of a wild type bovine lentiviral ENV protein, said mutated ENV protein having at least 70% identity, preferably at least 80% identity, to the sequence SEQ ID NO: 423, said mutated bovine lentiviral ENV protein or fragment thereof comprising a mutated immunosuppressive domain (ISU) containing the following amino acid sequence:

$$\text{Y-L-}Z^A_1\text{-}Z^A_2\text{-}Z^A_3\text{-}Z^A_4\text{-}Z^A_5\text{-V-H,} \quad \text{(SEQ ID NO: 424)}$$

wherein, $Z^A_1$ is any amino acid different from E or deleted, and/or
$Z^A_2$ is any amino acid different from F or deleted, and/or
$Z^A_3$ is any amino acid different from L or deleted, and/or
$Z^A_4$ is any amino acid different from A or deleted, and/or
$Z^A_5$ is any amino acid different from E or deleted, in association with a pharmaceutically acceptable carrier.

In another aspect, the invention also relates to a pharmaceutical composition comprising as active substance an isolated mutated bovine lentiviral ENV protein having a decreased immunosuppressive activity, substantially no immunosuppressive activity or no immunosuppressive activity, or a fragment thereof, said mutated bovine lentiviral ENV protein resulting from mutation of the transmembrane (TM) subunit of a wild type bovine lentiviral ENV protein, said mutated ENV protein having at least 70% identity, preferably at least 80% identity, to the sequence SEQ ID NO: 423, said mutated bovine lentiviral ENV protein or fragment thereof comprising a mutated immunosuppressive domain (ISU) containing the following amino acid sequence:

$$\text{V-T-Y-L-}Z^A_1\text{-}Z^A_2\text{-}Z^A_3\text{-}Z^A_4\text{-}Z^A_5\text{-V-H-E-[L/V]-Q,} \quad \text{(SEQ ID NO: 425)}$$

wherein, $Z^A_1$ is any amino acid different from E or deleted, and/or
$Z^A_2$ is any amino acid different from F or deleted, and/or
$Z^A_3$ is any amino acid different from L or deleted, and/or
$Z^A_4$ is any amino acid different from A or deleted, and/or
$Z^A_5$ is any amino acid different from E or deleted, in association with a pharmaceutically acceptable carrier.

In a particular embodiment, the invention relates to a pharmaceutical composition as defined above, wherein said mutated bovine lentiviral Env protein, or said fragment thereof, further comprises additional mutations of at least one amino acid chosen among the $5^{th}$, $6^{th}$, $7^{th}$, $8^{th}$ and $9^{th}$ amino acids, in particular the $7^{th}$ amino acid, located upstream the amino acid $Z^A_1$ of SEQ ID NO: 421, SEQ ID NO: 422, SEQ ID NO: 424 or SEQ ID NO: 425.

In another aspect, the invention relates to a pharmaceutical composition comprising as active substance a nucleic acid molecule coding for a mutated bovine lentiviral ENV protein, or a fragment of said mutated bovine lentiviral ENV protein, as defined above.

In another aspect, the invention also relates to a pharmaceutical composition comprising as active substance an isolated mutated equine lentiviral ENV protein having a decreased immunosuppressive activity, substantially no immunosuppressive activity or no immunosuppressive activity, or a fragment thereof, said mutated equine lentiviral ENV protein resulting from mutation of the transmembrane (TM) subunit of a wild type equine lentiviral ENV protein, said mutated ENV protein having at least 70% identity, preferably at least 80% identity, to the sequence SEQ ID NO: 426, said mutated equine lentiviral ENV protein or fragment thereof comprising a mutated immunosuppressive domain (ISU) containing the following amino acid sequence:

$$\text{L-L-}Z^B_1\text{-}Z^B_2\text{-}Z^B_3\text{-}Z^B_4\text{-}Z^B_5\text{-[V/I]-E,} \quad \text{(SEQ ID NO: 427)}$$

wherein, $Z^B_1$ is any amino acid different from K or deleted, and/or
$Z^B_2$ is any amino acid different from E or deleted, and/or
$Z^B_3$ is any amino acid different from R or K or Q or deleted, and/or
$Z^B_4$ is any amino acid different from Q or deleted, and/or
$Z^B_5$ is any amino acid different from Q or L or K or deleted, and/or in association with a pharmaceutically acceptable carrier.

In another aspect, the invention also relates to a pharmaceutical composition comprising as active substance an isolated mutated equine lentiviral ENV protein having a decreased immunosuppressive activity, substantially no immunosuppressive activity or no immunosuppressive activity, or a fragment thereof, said mutated equine lentiviral ENV protein resulting from mutation of the transmembrane (TM) subunit of a wild type equine lentiviral ENV protein, said mutated ENV protein having at least 70% identity, preferably at least 80% identity, to the sequence SEQ ID NO: 426, said mutated equine lentiviral ENV protein or fragment thereof comprising a mutated immunosuppressive domain (ISU) containing the following amino acid sequence:

$$V\text{-}[Q/R]\text{-}L\text{-}L\text{-}Z^B_1\text{-}Z^B_2\text{-}Z^B_3\text{-}Z^B_4\text{-}Z^B_5\text{-}[V/I]\text{-}E\text{-}E\text{-}T\text{-}F, \quad (\text{SEQ ID NO: 428})$$

wherein, $Z^B_1$ is any amino acid different from K or deleted, and/or
$Z^B_2$ is any amino acid different from E or deleted, and/or
$Z^B_3$ is any amino acid different from K or Q or deleted, and/or
$Z^B_4$ is any amino acid different from Q or deleted, and/or
$Z^B_5$ is any amino acid different from Q or L or K or deleted, and/or in association with a pharmaceutically acceptable carrier.

In a particular embodiment, the invention relates to a pharmaceutical composition as defined above, wherein said mutated equine lentiviral ENV protein, or said fragment thereof, further comprises additional mutations of at least one amino acid chosen among the 5$^{th}$, 6$^{th}$, 7$^{th}$, 8$^{th}$ and 9$^{th}$ amino acids, in particular the 7$^{th}$ amino acid, located upstream the amino acid $Z^A_1$ of SEQ ID NO: 427 or SEQ ID NO: 428.

In another aspect, the invention relates to a pharmaceutical composition comprising as active substance a nucleic acid molecule coding for a mutated equine lentiviral ENV protein, or a fragment of said mutated equine lentiviral ENV protein, as defined above.

In another aspect, the invention also relates to a pharmaceutical composition comprising as active substance an isolated mutated caprine lentiviral ENV protein having a decreased immunosuppressive activity, substantially no immunosuppressive activity or no immunosuppressive activity, or a fragment thereof, said mutated caprine lentiviral ENV protein resulting from mutation of the transmembrane (TM) subunit of a wild type caprine lentiviral ENV protein, said mutated ENV protein having at least 70% identity, preferably at least 80% identity, to the sequence SEQ ID NO: 429, said mutated caprine lentiviral ENV protein or fragment thereof comprising a mutated immunosuppressive domain (ISU) containing the following amino acid sequence:

$$R\text{-}[V/M]\text{-}Z^A_1\text{-}Z^A_2\text{-}Z^A_3\text{-}Z^A_4\text{-}Z^A_5\text{-}R\text{-}[M/I], \quad (\text{SEQ ID NO: 432})$$

wherein, $Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or
$Z^A_5$ is any amino acid different from D or deleted, in association with a pharmaceutically acceptable carrier.

In another aspect, the invention also relates to a pharmaceutical composition comprising as active substance an isolated mutated caprine lentiviral ENV protein having a decreased immunosuppressive activity, substantially no immunosuppressive activity or no immunosuppressive activity, or a fragment thereof, said mutated caprine lentiviral ENV protein resulting from mutation of the transmembrane (TM) subunit of a wild type caprine lentiviral ENV protein, said mutated ENV protein having at least 70% identity, preferably at least 80% identity, to the sequence SEQ ID NO: 429, said mutated caprine lentiviral ENV protein or fragment thereof comprising a mutated immunosuppressive domain (ISU) containing the following amino acid sequence:

$$V\text{-}A\text{-}R\text{-}[V/M]\text{-}Z^A_1\text{-}Z^A_2\text{-}Z^A_3\text{-}Z^A_4\text{-}Z^A_5\text{-}R\text{-}[M/I]\text{-}M\text{-}[L/I/V]\text{-}Y, \quad (\text{SEQ ID NO: 433})$$

wherein, $Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or
$Z^A_5$ is any amino acid different from D or deleted, in association with a pharmaceutically acceptable carrier.

In a particular embodiment, the invention relates to a pharmaceutical composition as defined above, wherein said mutated caprine lentiviral ENV protein, or said fragment thereof, further comprises additional mutations of at least one amino acid chosen among the 5$^{th}$, 6$^{th}$, 7$^{th}$, 8$^{th}$ and 9$^{th}$ amino acids, in particular the 7$^{th}$ amino acid, located upstream the amino acid $Z^A_1$ of SEQ ID NO: 432 or SEQ ID NO: 433.

In another aspect, the invention relates to a pharmaceutical composition comprising as active substance a nucleic acid molecule coding for a mutated caprine lentiviral ENV protein, or a fragment of said mutated caprine lentiviral ENV protein, as defined above.

In another aspect, the invention also relates to a pharmaceutical composition comprising as active substance an isolated mutated ovine lentiviral ENV protein having a decreased immunosuppressive activity, substantially no immunosuppressive activity or no immunosuppressive activity, or a fragment thereof, said mutated ovine lentiviral ENV protein resulting from mutation of the transmembrane (TM) subunit of a wild type ovine lentiviral ENV protein, said mutated ENV protein having at least 70% identity, preferably at least 80% identity, to the sequence SEQ ID NO: 430, said mutated ovine lentiviral ENV protein or fragment thereof comprising a mutated immunosuppressive domain (ISU) containing the following amino acid sequence:

$$R\text{-}[V/M]\text{-}Z^A_1\text{-}Z^A_2\text{-}Z^A_3\text{-}Z^A_4\text{-}Z^A_5\text{-}R\text{-}[M/I], \quad (\text{SEQ ID NO: 432})$$

wherein, $Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or $Z^A_5$ is any amino acid different from D or deleted,
in association with a pharmaceutically acceptable carrier.

In another aspect, the invention also relates to a pharmaceutical composition comprising as active substance an isolated mutated ovine lentiviral ENV protein having a decreased immunosuppressive activity, substantially no immunosuppressive activity or no immunosuppressive activity, or a fragment thereof, said mutated ovine lentiviral ENV protein resulting from mutation of the transmembrane (TM) subunit of a wild type ovine lentiviral ENV protein, said mutated ENV protein having at least 70% identity, preferably at least 80% identity, to the sequence SEQ ID NO: 430 said mutated ovine lentiviral ENV protein or fragment thereof comprising a mutated immunosuppressive domain (ISU) containing the following amino acid sequence:

$$\text{V-A-R-[V/M]-}Z^A_1\text{-}Z^A_2\text{-}Z^A_3\text{-}Z^A_4\text{-}Z^A_5\text{-R-[M/I]-M-[L/I/V]-Y,} \quad \text{(SEQ ID NO: 433)}$$

wherein,
$Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or
$Z^A_5$ is any amino acid different from D or deleted,
in association with a pharmaceutically acceptable carrier.

In another aspect, the invention also relates to a pharmaceutical composition comprising as active substance an isolated mutated ovine lentiviral ENV protein having a decreased immunosuppressive activity, substantially no immunosuppressive activity or no immunosuppressive activity, or a fragment thereof, said mutated ovine lentiviral ENV protein resulting from mutation of the transmembrane (TM) subunit of a wild type ovine lentiviral ENV protein, said mutated ENV protein having at least 70% identity, preferably at least 80% identity, to the sequence SEQ ID NO: 431 said mutated ovine lentiviral ENV protein or fragment thereof comprising a mutated immunosuppressive domain (ISU) containing the following amino acid sequence:

$$\text{R-[V/M]-}Z^A_1\text{-}Z^A_2\text{-}Z^A_3\text{-}Z^A_4\text{-}Z^A_5\text{-R-[M/I],} \quad \text{(SEQ ID NO: 432)}$$

wherein,
$Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or
$Z^A_5$ is any amino acid different from D or deleted,
in association with a pharmaceutically acceptable carrier.

In another aspect, the invention also relates to a pharmaceutical composition comprising as active substance an isolated mutated ovine lentiviral ENV protein having a decreased immunosuppressive activity, substantially no immunosuppressive activity or no immunosuppressive activity, or a fragment thereof, said mutated ovine lentiviral ENV protein resulting from mutation of the transmembrane (TM) subunit of a wild type ovine lentiviral ENV protein, said mutated ENV protein having at least 70% identity, preferably at least 80% identity, to the sequence SEQ ID NO: 431 said mutated ovine lentiviral ENV protein or fragment thereof comprising a mutated immunosuppressive domain (ISU) containing the following amino acid sequence:

$$\text{V-A-R-[V/M]-}Z^A_1\text{-}Z^A_2\text{-}Z^A_3\text{-}Z^A_4\text{-}Z^A_5\text{-R-[M/I]-M-[L/I/V]-Y,} \quad \text{(SEQ ID NO: 433)}$$

wherein,
$Z^A_1$ is any amino acid different from E or deleted, and/or
$Z^A_2$ is any amino acid different from A or T or V or deleted, and/or
$Z^A_3$ is any amino acid different from I or L or V or M or deleted, and/or
$Z^A_4$ is any amino acid different from T or V or M or I or deleted, and/or
$Z^A_5$ is any amino acid different from D or deleted,
in association with a pharmaceutically acceptable carrier.

In a particular embodiment, the invention relates to a pharmaceutical composition as defined above, wherein said mutated ovine lentiviral ENV protein, or said fragment thereof, further comprises additional mutations of at least one amino acid chosen among the $5^{th}$, $6^{th}$, $7^{th}$, $8^{th}$ and $9^{th}$ amino acids, in particular the $7^{th}$ amino acid, located upstream the amino acid $Z^A_1$ of SEQ ID NO: 432 or SEQ ID NO: 433.

In another aspect, the invention relates to a pharmaceutical composition comprising as active substance a nucleic acid molecule coding for a mutated ovine lentiviral ENV protein, or a fragment of said mutated ovine lentiviral ENV protein, as defined above.

LEGEND TO THE FIGURES

FIG. 1:
(A) FIV Envelope phylogeny, with the A-D subtypes indicated and the reference Petaluma strain boxed (from Pu et al, *Journal of Feline Medicine and Surgery*, 2005, 7:65-70).

(B) Structure of the FIV Envelope protein, delineation of the characteristic functional domains and alignment of the 64-aa immunosuppressive-containing domains from selected FIV Env proteins. The SU and TM subunits of the FIV Env are indicated, together with the fusion peptide, the transmembrane anchoring domain of the TM subunit, and the immunosuppressive domain (ISD).

The aligned sequences of the 64-aa immunosuppressive-containing domains correspond to fragments of the Envelope protein from 33 distinct strains (i.e. 33 different accession numbers), only 20 of these 64-aa fragments are different (i.e. 20 SEQ ID numbers have been given).

Figure 2:
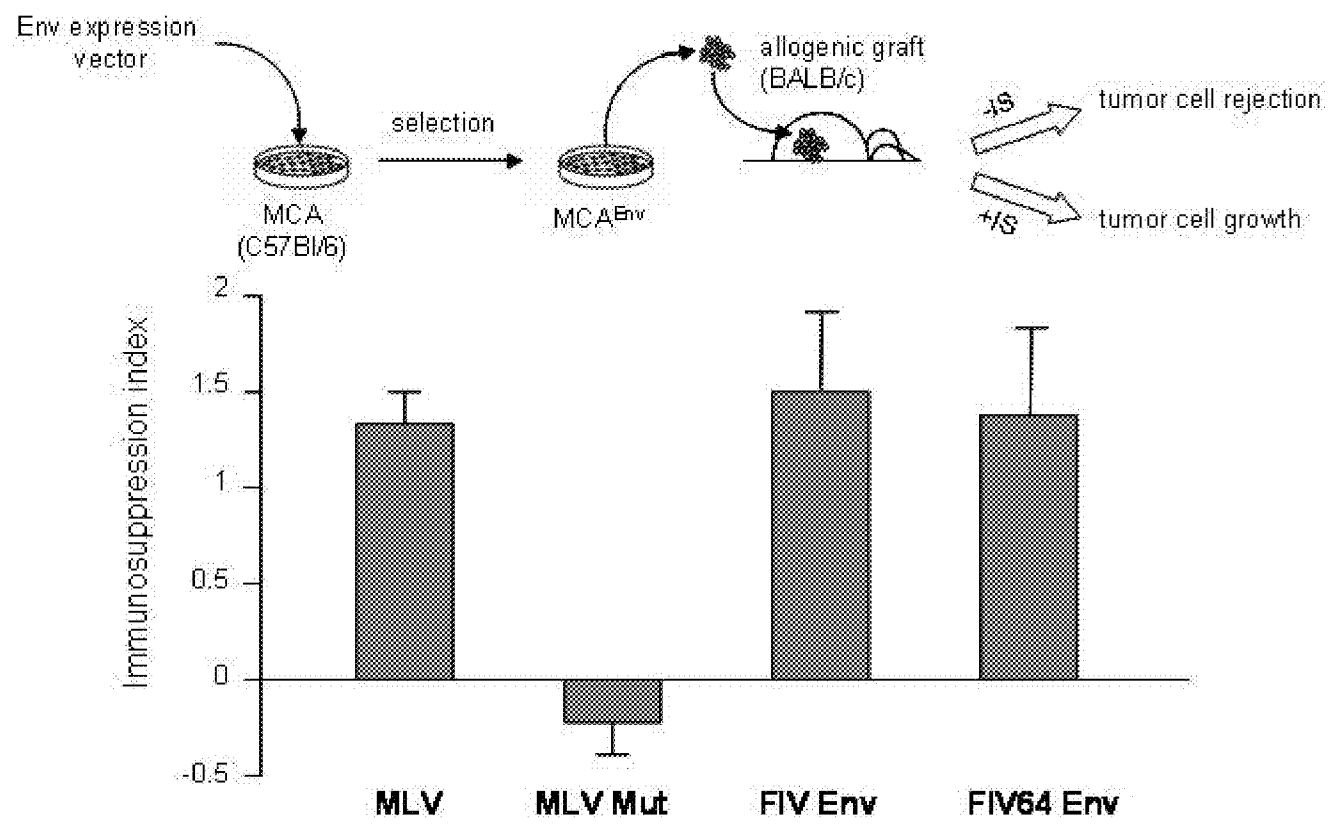

FIG. 2:
Immunosuppressive activity of the full-length FIV envelope protein (FIV Env) and of the 64 aa-long FIV envelope subdomain delineated in FIG. 1 (FIV64 Env). Immunosuppression was tested using the in vivo MCA205 tumor rejection assay (see scheme on top and Materials and Methods): MCA205 tumor cells are transduced with an expression vector (containing a selectable hygromycin gene) for the indicated Env protein or fragment, stably transduced cells are then selected for expression of the corresponding Env, and are finally engrafted into Balb/c mice (allogenic graft, normally resulting in tumor rejection); tumor growth/rejection is then monitored and provides an immunosuppressive index (calculated as indicated in Materials and Methods). Y-axis corresponds to the value of the immunosuppression index. Immunosuppression indexes are means of at least 3 independent experiments, with standard deviation. The Murine Leukemia Virus (MLV) envelope ectodomains, wild-type and mutant (Schlecht-Louf et al., *Proc Natl Acad Sci USA*. 2010, 107(8):3782-7) are used as an internal control.

Figure 4:
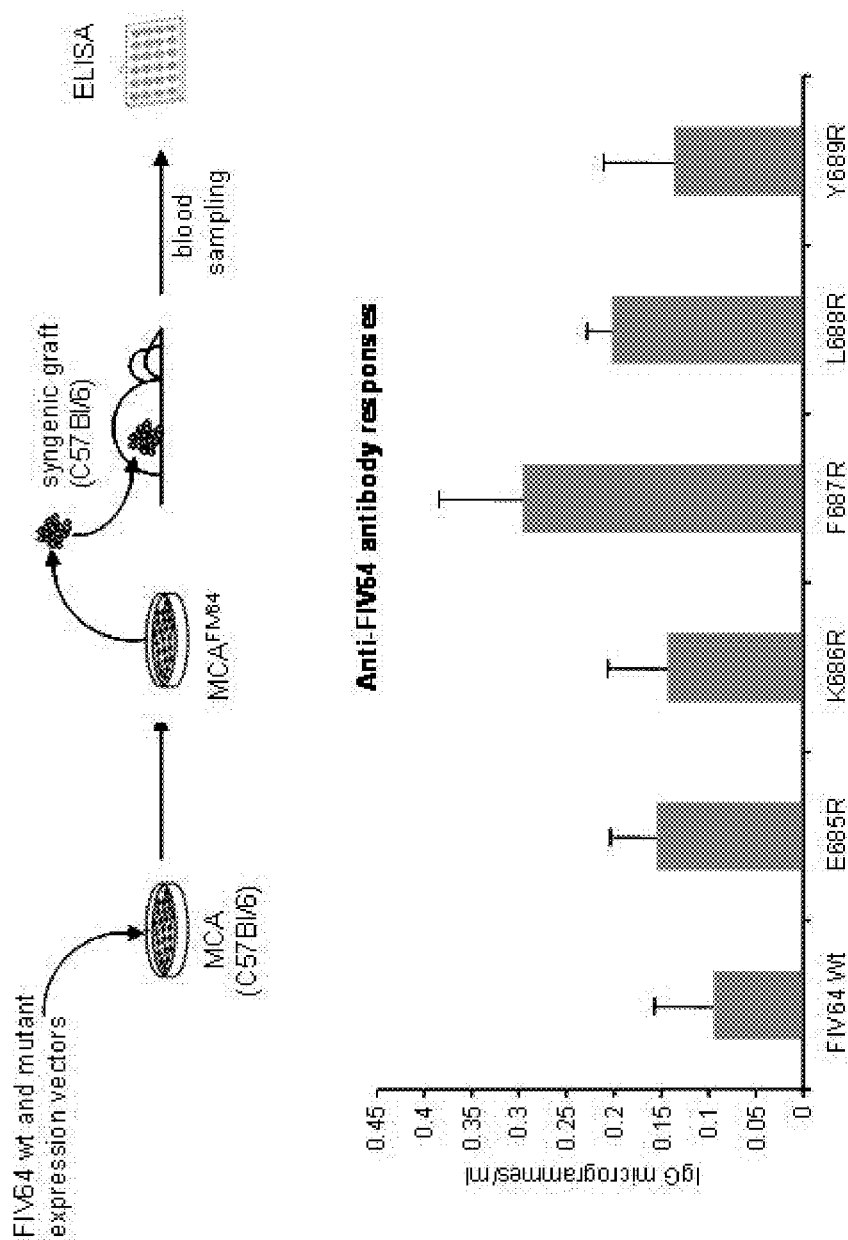

FIG. 3:

Functional identification of the aminoacids in the FIV envelope 64 aa domain directly involved in immunosuppressive activity, and search for aminoacid substitutions inhibiting this activity. Immunosuppressive activity was tested as in FIG. 2, using the in vivo MCA205 tumor rejection assay (see Materials and Methods). The mutated aminoacids are indicated with their position (see sequence of FIV64 on top) and the nature of the substitution. Wwt and Wmut are controls (from the human endogenous retrovirus HERV-W Envelope, Mangeney et al., *Proc Natl Acad Sci USA*. 2007, 104(51):20534-9). Immunosuppression indexes correspond to 3 independent experiments, with standard deviation.

FIG. 4:

Antibody response of mice inoculated with cells expressing wild-type and mutant FIV64 Env domains (see scheme on top): MCA205 tumor cells are stably transduced as in FIG. 2 with expression vectors for the indicated FIV64 Env wt and mutants, and cells engrafted into C57Bl/6 mice (syngenic graft, resulting in constant tumor growth without rejection); specific anti-FIV64 antibodies are quantitated from the collected blood samples as indicated in Materials and Methods. Results are representative of 2 independent experiments.

FIG. 5:

Antibody response of mice injected with MBP-FIV64, wt and mutants, recombinant proteins (see scheme on top): FIV64 Env, wt and mutants, fused with MBP are i.v. injected three times with a 1-week interval into Balb/C mice (10 μg per injection); mice are then blood-sampled and anti-MBP IgG levels are determined by ELISA using plates coated with MBP-LacZα (MBP-LacZα is a control MBP fusion with the 83aa LacZα fragment (α-subunit of *E. coli* β-galactosidase, see Materials and Methods). Results are representative of 2 independent experiments.

FIG. 6:

Expression of the FIV Env proteins, wt and mutants, at the surface of cells transfected with the indicated expression vectors (see scheme on top).

Expression profile of the wild-type and mutant FIV Env proteins was assayed by FACS analysis using full-length FIVenv-expressing vectors and an anti-SU FIVenv monoclonal antibody (Antibodies-online, BmbH, Germany). The data correspond to the Mean Fluorescence Intensity, from three independent experiments, with standard deviation.

FIG. 7:

Functional characterization of the FIV Env proteins, wild-type (wt) and mutants. Fusogenic activity of the FIVenv, wild-type and mutants, are measured by a cell-cell fusion assay and quantified by a fusion index (see scheme on top and Materials and Methods). The data correspond to three independent experiments, with standard deviation).

EXAMPLES

The FIV Envelope and a Delineated Subdomain of the TM Subunit are Immunosuppressive In Vivo Identification of an immunosuppressive activity of the FIV envelope and of the domain within the FIV envelope responsible for this activity was achieved using an in vivo tumor rejection assay that we had previously used to demonstrate the immunosuppressive activity of the Env protein of oncoretroviruses (e.g. murine MoMLV and simian MPMV, see Mangeney and Heidmann, *Proc Natl Acad Sci USA,* 1998, 95:14920-14925; Mangeney et al., *Proc Natl Acad Sci USA,* 2007, 104(51):20534-9).

The rationale of the assay can be summarized as follows: while injection of MCA205 tumor cells (H-$2^b$) into allogeneic Balb/c mice (H-$2^d$) leads to the formation of no tumor or transient tumors that are rapidly rejected, injection of the same cells, but stably expressing an immunosuppressive retroviral Env protein, leads to the growth of larger tumors that persist for a longer time-in spite of the expression of the new exogenous antigen.

This difference is not associated with a difference in intrinsic cell growth rate since it is not observed in syngeneic C57BL/6 mice, and is immune system-dependent.

The extent of “immunosuppression” can be quantified by an index based on tumor size: $(A_{env}-A_{none})/A_{none}$, where $A_{env}$ and $A_{none}$ are the mean areas at the peak of growth of tumors from Balb/c mice injected with env-expressing or control cells, respectively. A positive index indicates that env expression facilitates tumor growth, as a consequence of its immunosuppressive activity; a null or negative index points to no effect or even an inhibitory effect, respectively. The latter can be explained by a stimulation of the immune response of the host against the new foreign antigen, represented by a non-immunosuppressive Env protein, expressed at the surface of tumor cells. Accordingly, as illustrated in FIG. 2, it can be observed that the FIV env is immunosuppressive, and that this activity is carried by a 64-mer peptide of the transmembrane (TM) subunit of the envelope protein. The immunosuppression indexes are close to those found for non-lentiviral env proteins (such as that of the murine MLV retrovirus shown in the figure as a control, together with a non-immunosuppressive mutant).

Identification of the FIV Env Amino-Acids Critical for Immunosuppression and its Inhibition, Via R-Scanning To characterize further the immunosuppressive domain (ISD) of the FIV env active in vivo, we analyzed the effect of a series of amino-acid substitutions within the FIV env 64 aa domain shown to carry the IS activity (see above). The 64-aa FIV env domain is embedded into the so-called ectodomain, which corresponds to the extracellular domain of the TM subunit, and consists in the α-helical domain involved in FIV TM trimerization, and the N-term part of the loop containing the 2 well-conserved, 6/7 aa-distant, cysteine residues found in most retroviral envelopes. Refine delineation of the amino acids responsible for IS activity was thus performed by arginine-scanning within this domain. As illustrated in FIG. 3, X-to-Arg substitutions resulted in a significant change in the IS activity of the FIVenv 64 aa domain, with maximum effect observed for the F687 position and to a lesser—but significant—extent for the adjacent E685, K686, L688 and Y689 positions. A series of other substitutions are performed at the F687 position, substitutions for the small A and G, and the hydrophobic L and F residues.

We also analyzed the effect of this series of amino-acid substitutions within the FIVenv 64 aa domain by measuring the production of anti-FIV env IgG antibodies in mice inoculated under syngenic conditions (C57Bl/6 mice) with the cells expressing the wild-type and mutant FIVenv 64 aa domains. As illustrated in FIG. 4, X-to-Arg substitutions resulted in an increase in the antibody response, consistent with an increased immunogenicity of FIVenv 64, with again a more important effect observed for the F687 position.

Figure 5:
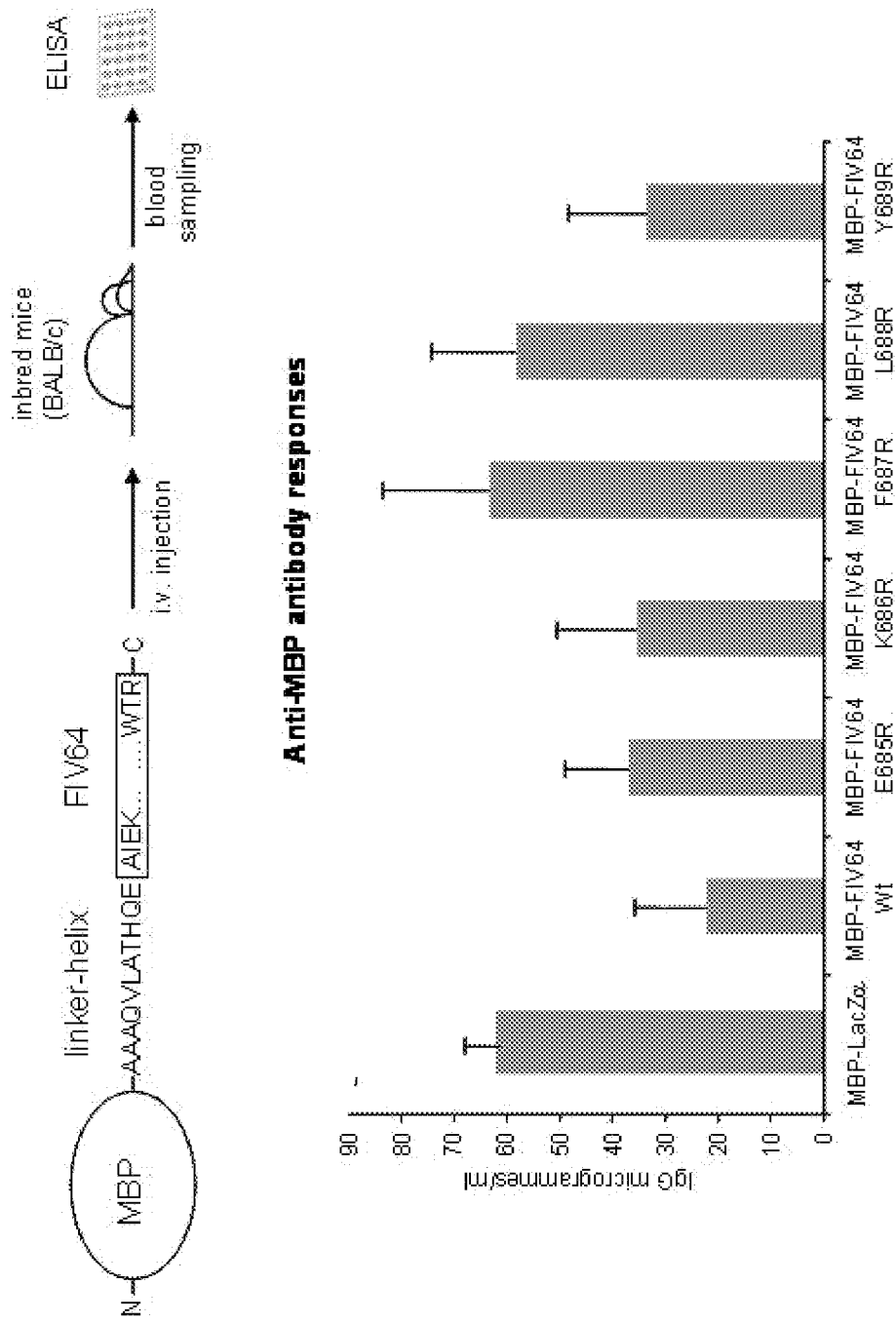

Additionally, a series of experiments were performed with recombinant proteins containing the FIVenv 64 domain, to assay the relative immunogenicity of the wt and mutants proteins. The domains were fused with the carrier MBP (Maltose Binding Protein), and the proteins were injected i.v. into Balb/C mice (see Materials and Methods). The immunosuppressive effects of the FIVenv 64 wt and mutants were assayed by measuring the inhibition of the anti-MBP antibody response raised in the injected mice. As illustrated in FIG. 5, a significant decrease—relative to the control (MBP-LacZα)—is observed with FIVenv 64 wt, consistent with its immunosuppressive activity acting in cis, whereas almost no reduction is observed for the F687R and L688R mutants, indicative of the loss of its IS activity. A similar effect is observed for the other mutants, although at a lesser extent.

Figure 6:
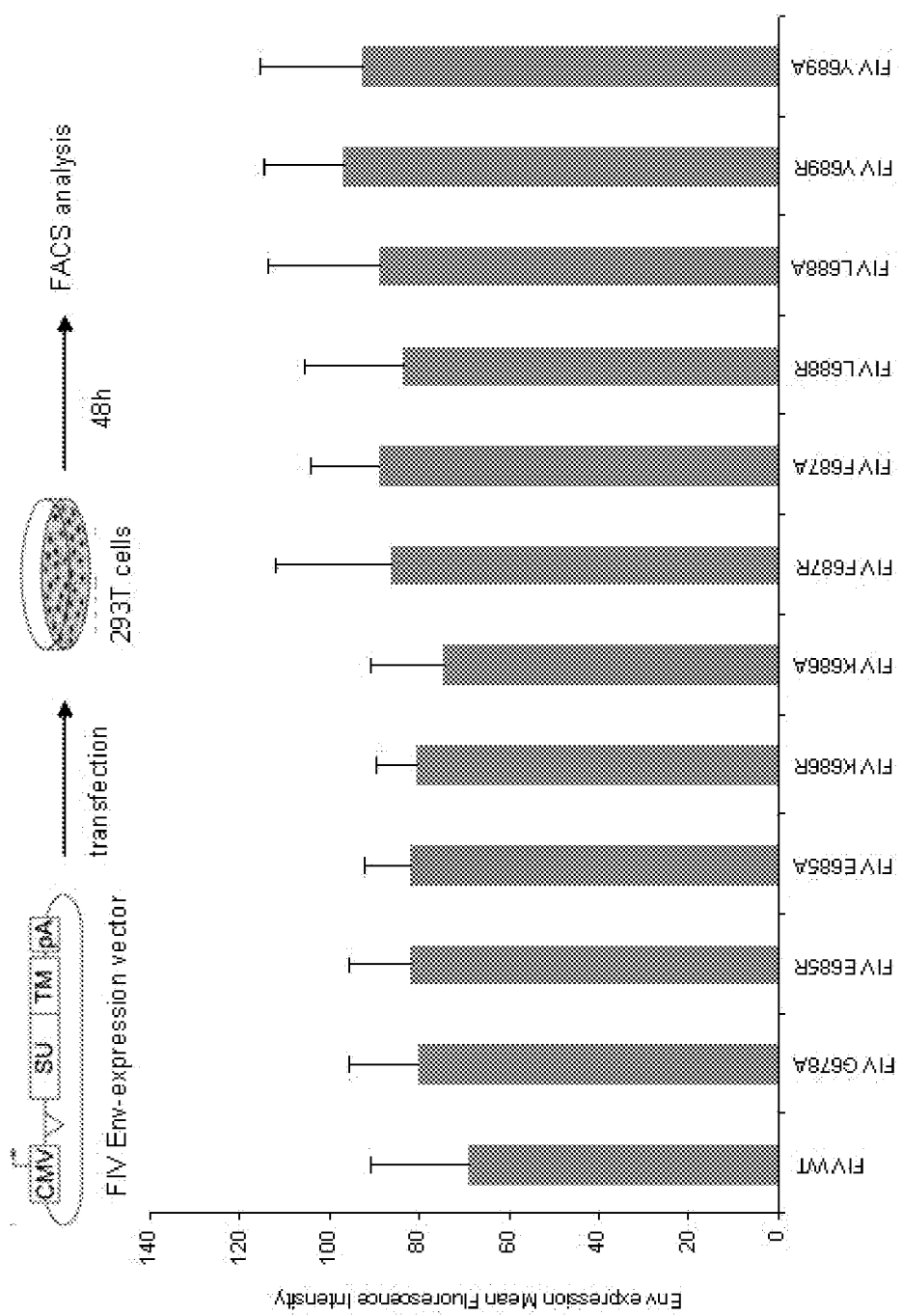
Figure 7:
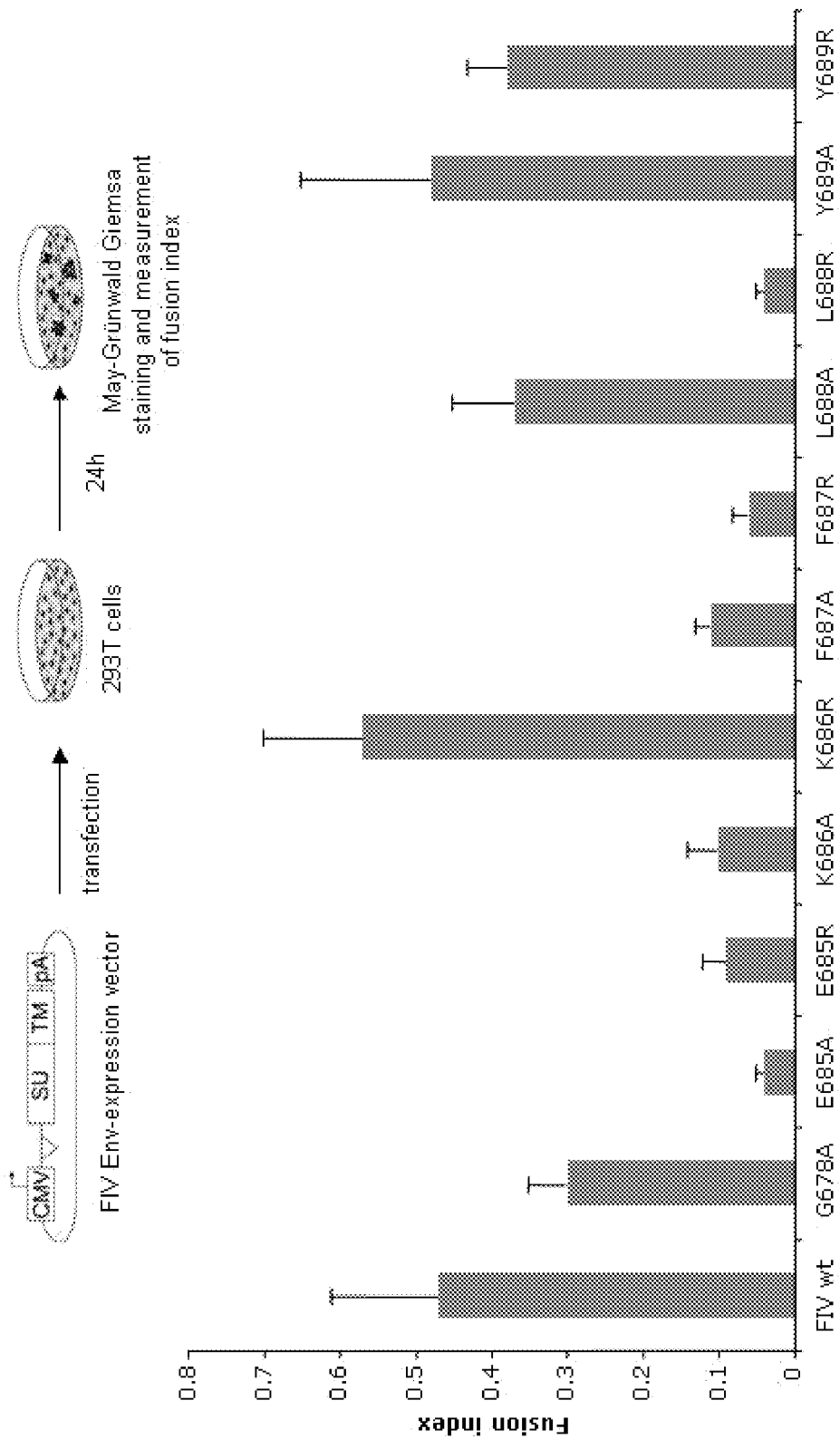

Impact of the Identified Mutations on Env Protein Folding and Proper Expression as a Functional Transmembrane Protein We then tested whether the above-mentioned substitutions alter the overall capacity of the FIV envelope to be expressed by an eucaryotic cell and to be exported at the cell membrane, by introducing the mutants into an expression vector for the full-length FIV envelope. A FACS analysis of cells transfected with the wild-type and the mutant FIV envelope genes inserted within a CMV-driven expression vector (see Materials and Methods) and using an anti-SU specific monoclonal antibody, demonstrated quantitative expression of the mutant envelopes at the cell surface (FIG. 6). In particular, this analysis indicated that the F687R and L688R mutations did not significantly altered the FIV Env structure and/or SU-TM interaction. Finally, the fusogenic activity of the FIV full-length envelopes was tested by a cell-cell fusion assay, in which cells prone to FIVenv-mediated fusion were transfected as above with the corresponding expression vectors, and cell-cell fusion monitored 24-48 h post transfection by measuring the amount of multi-nucleated syncytia formed, with the process being quantified by a fusion index (see Materials and Methods). As illustrated in FIG. 7 and despite the conservation of the amount of env protein expressed at the cell surface (cf FIG. 6), variations in the fusion index exist among the various env mutants tested, although all of them remain fusion-positive, Accordingly, the present investigation has clearly identified definite positions and definite substitutions within the FIV env resulting in the loss of its IS activity.

Being compatible with the conservation of the overall structure of the FIV Env protein, these substitutions should be introduced in all pharmaceutical preparations which include the Env protein as a vaccine antigen.

Materials and Methods

Mice and Cell Lines:

C57Bl/6 and Balb/c mice, 6-10 weeks old, were obtained from Harlan (France). Mice were maintained in the animal facility of the Gustave Roussy Institute in accordance with institutional regulations. 293T (ATCC CRL11268), and MCA205 cells were cultured in DMEM supplemented with 10% fetal calf serum (Invitrogen), streptomycin (100 µg/ml) and penicillin (100 units/ml).

Plasmids Constructions:

phCMV-FIVenv: The pET34TF10 full feline immunodeficiency virus (FIV) genome clone (strain petaluma) (Talbott et al., *Proc Natl Acad Sci USA*, 1989, 86(15): 5743-4747) served as template to generate full-length FIVenv PCR fragment using primers 1-2. This PCR fragment was digested with XhoI and MluI restriction enzymes to be ligated with phCMV vector opened with the same enzymes to generate a phCMV-FIVenv expression vector.

phCMV-FIVenv mutants: Mutated phCMV-FIVenv was obtained by successive PCRs using appropriate primers. A first series of PCRs was performed with phCMV-FIVenv as template with primer 3 and the reverse primer designed with the mutation (i.e. primers 5, 7, 9, 11, 13, 15, 17, 19, 21, 23); and primer 2 and the forward primer bearing the mutation (i.e. primers 4, 6, 8, 10, 12, 13, 14, 16, 18, 20, 22) to introduce the mutations E685A, E685R, K686A, K686R, F687A, F687R, L688A, L688R, Y689A and Y689R, respectively. The two PCR fragments bearing the same mutation were purified and mixed to be used as template for a subsequent PCR with primers 3 and 2. These PCR fragments were digested by SpeI and MluI restriction enzymes and purified. In the meantime the FIVenv fragment obtained after digestion of the phCMV-FIVenv with the XhoI and SpeI restriction enzymes was purified. A three-fragment ligation with phCMV opened with XhoI and MluI, the FIVenv fragment digested with XhoI and SpeI, and the SpeI-MluI-restricted PCR fragment with the desired mutation, was performed to obtain the phCMV-FIVenv mutants.

Mutations of the amino acids E685, K686 and Y689 into G, L or F, mutations of the amino acid F687 into G or L, and mutations of the amino acid L688 into G or F are similarly performed using appropriate primers pairs (i.e. primers 31-58).

pDFG-FIVenv and pDFG-FIVenv mutants: FIVenv and FIVenv mutant inserts were obtained by restriction with AgeI and MluI of the phCMV-FIVenv and mutants. These inserts were ligated with pDFG-ectoSyncytin-1 (see above Mangeney et al, PNAS, 2007) opened with the same enzymes.

pDFG-FIV64 and pDFG-FIV112, wild-type and mutants: fragments of the FIVenv, wild-type and mutants, were PCR-amplified from phCMV-FIVenv using primers 24-25 or 24-26 to obtain FIV64 and FIV112 fragments, respectively. These PCR fragments were digested with SfiI and MluI and inserted into pDFG-ectoSyncytin-1 (see above Mangeney et al, PNAS, 2007) opened with the same enzymes.

pSIN-FIV64: This vector was based on the lentiviral vector pHR'SIN-cPPT-SEW described in Demaison et al. (*Human Gene Therapy*, 2002, 13:803-813). The pSIN-FIV64 vectors were obtained by insertion of the hygromycin resistance gene under the control of the phosphoglycerate kinase promoter (PGK) at the end of WPRE sequence of pHR'SIN-cPPT-SEW. Then the FIV-64 fragments, wt and mutants, were PCR-amplified from pDFG-FIV64 wt and mutants, using primers 27-28, digested with Bam HI and Not I, and inserted downstream the pSec sequence under control of the SFFV promoter.

pMal-MBP-FIV: Bacterial expression vectors for fusion proteins with *E. coli* maltose-binding protein (MBP) were constructed by ligation of a modified pMal-c2x (described in Center et al., *Protein Sci*, 1998, 7(7): 1612-1619) opened with PstI and HindIII, with the FIV-env ectodomain, wt and mutants, obtained by PCR from phCMV Env wt and mutants, with primer pair 29-30. These pMal-MBP-FIV64 vectors encode a 64-residue long FIV-ectodomain fused to the C terminus of MBP through a trialanine linker. The empty pMal-c2x vector encodes the 85-residue long α-subunit of *E. coli* β-galactosidase fused to the C terminus of MBP and was used as a control (pMal-LacZα).

All the constructions were sequenced before use.

TABLE 2

Primer list

| No | Name | Primer sequence (5'-3') | SEQ ID NO: |
|---|---|---|---|
| 1 | FIV env Xho Age Kozak ATG (FOR) | atacatCTCGAGACCGGTccaactagaaccATGGCAGAAGGATTTGCAGCC | 348 |
| 2 | FIV env Stop Mlu (REV) | ATACATacgcgtTCATTCCTCCTCTTTTTCAGACATGCCAC | 349 |
| 3 | FIV-env-2000-FOR | TACTGCTATAGGGATGGTAACACAATACCACCAAG | 350 |
| 4 | FIV-env-E685A-FOR | GATTAAAAGTAGAAGCTATGGCAAAATTTTTGTATACAGC | 351 |
| 5 | FIV-env-E685A-REV | GCTGTATACAAAAATTTTGCCATAGCTTCTACTTTTAATC | 352 |
| 6 | FIV-env-E685R-FOR | GATTAAAAGTAGAAGCTATGAGAAAATTTTTGTATACAGC | 353 |
| 7 | FIV-env-E685R-REV | GCTGTATACAAAAATTTTCTCATAGCTTCTACTTTTAATC | 354 |
| 8 | FIV-env-K686A-FOR | GTAGAAGCTATGGAAGCATTTTGTATACAGCTTTC | 355 |
| 9 | FIV-env-K686A-REV | GAAAGCTGTATACAAAAATGCTTCCATAGCTTCTAC | 356 |
| 10 | FIV-env-K686R-FOR | GTAGAAGCTATGGAAAGATTTTGTATACAGCTTTC | 357 |
| 11 | FIV-env-K686R-REV | GAAAGCTGTATACAAAAATCTTTCCATAGCTTCTAC | 358 |
| 12 | FIV-env-F687A-FOR | GAAGCTATGGAAAAAGCCTTGTATACAGCTTTC | 359 |
| 13 | FIV-env-F687A-REV | GAAAGCTGTATACAAGGCTTTTTCCATAGCTTC | 360 |
| 14 | FIV-env-F687R-FOR | GAAGCTATGGAAAAAAGATTGTATACAGCTTTC | 361 |
| 15 | FIV-env-F687R-REV | GAAAGCTGTATACAATCTTTTTTCCATAGCTTC | 362 |
| 16 | FIV-env-L688A-FOR | GCTATGGAAAAATTTGCCTATACAGCTTTCGCTATG | 363 |
| 17 | FIV-env-L688A-REV | CATAGCGAAAGCTGTATAGGCAAATTTTTCCATAGC | 364 |
| 18 | FIV-env-L688R-FOR | GCTATGGAAAAATTTAGGTATACAGCTTTCGCTATG | 365 |
| 19 | FIV-env-L688R-REV | CATAGCGAAAGCTGTATACCTAAATTTTTCCATAGC | 366 |
| 20 | FIV-env-Y689A-FOR | CTATGGAAAAATTTTTGGCCACAGCTTTCGCTATGC | 367 |
| 21 | FIV-env-Y689A-REV | GCATAGCGAAAGCTGTGGCCAAAAATTTTTCCATAG | 368 |
| 22 | FIV-env-Y689R-FOR | CTATGGAAAAATTTTTGCGGACAGCTTTCGCTATGC | 369 |
| 23 | FIV-env-Y689R-REV | GCATAGCGAAAGCTGTCCGCAAAAATTTTTCCATAG | 370 |

TABLE 2-continued

Primer list

| No | Name | Primer sequence (5'-3') | SEQ ID NO: |
|---|---|---|---|
| 24 | FIV64-Sfi-FOR | GGTGACGCGGCCCAGCCGGCCgctatagaaaaggtgactggagcc | 371 |
| 25 | FIV64-Mlu-REV | ATACATACGCGTTTAccttgtccacaactcaagagg | 372 |
| 26 | FIVeq112-MLU-REV | ATACATACGCGTTTAccctgttttcccttgtacattattttg | 373 |
| 27 | BamHI psec-FOR | ATA GGA TCC AGA ACC ATG GAG ACA GAC ACA CTC | 435 |
| 28 | NotI FIV-REV | TAT GC GGCC GC TTA CCT TGT CCA CAA CTC AAG | 436 |
| 29 | PstI FIV72-FOR | ATAGCTGCAGCCCAAGTTCTGGCAACCCAT | 437 |
| 30 | HindIII FIV72-REV | TATAAGCTTTTACCTTGTCCACAACTCAAG | 438 |
| 31 | FIV-env-G678A-FOR | CATCAAGTACTAGTAATAGCATTAAAAGTAGAAGCTATG | 439 |
| 32 | FIV-env-G678A-REV | CATAGCTTCTACTTTTAATGCTATTACTAGTACTTGATG | 440 |
| 33 | FIV-env-E685G-FOR | GATTAAAAGTAGAAGCTATGGGAAAATTTTTGTATACAGC | 441 |
| 34 | FIV-env-E685G-REV | GCTGTATACAAAAATTTTCCCATAGCTTCTACTTTTAATC | 442 |
| 35 | FIV-env-E685L-FOR | GATTAAAAGTAGAAGCTATGTTAAAATTTTTGTATACAGC | 443 |
| 36 | FIV-env-E685L-REV | GCTGTATACAAAAATTTTAACATAGCTTCTACTTTTAATC | 444 |
| 37 | FIV-env-K686G-FOR | GTAGAAGCTATGGAAGGATTTTTGTATACAGCTTTC | 445 |
| 38 | FIV-env-K686G-REV | GAAAGCTGTATACAAAAATCCTTCCATAGCTTCTAC | 446 |
| 39 | FIV-env-K686L-FOR | GTAGAAGCTATGGAATTATTTTGTATACAGCTTTC | 447 |
| 40 | FIV-env-K686L-REV | GAAAGCTGTATACAAAAATAATTCCATAGCTTCTAC | 448 |
| 41 | FIV-env-F687G-FOR | GAAGCTATGGAAAAAGGATTGTATACAGCTTTC | 449 |
| 42 | FIV-env-F687G-REV | GAAAGCTGTATACAATCCTTTTTCCATAGCTTC | 450 |
| 43 | FIV-env-F687L-FOR | GAAGCTATGGAAAAATTATTGTATACAGCTTTC | 451 |
| 44 | FIV-env-F687L-REV | GAAAGCTGTATACAATAATTTTTCCATAGCTTC | 452 |
| 45 | FIV-env-L688G-FOR | GCTATGGAAAAATTTGGATATACAGCTTTCGCTATG | 453 |
| 46 | FIV-env-L688G-REV | CATAGCGAAAGCTGTATATCCAAATTTTTCCATAGC | 454 |
| 47 | FIV-env-Y689G-FOR | CTATGGAAAAATTTTGGGAACAGCTTTCGCTATGC | 455 |
| 48 | FIV-env-Y689G-REV | GCATAGCGAAAGCTGTTCCCAAAATTTTTCCATAG | 456 |
| 49 | FIV-env-Y689L-FOR | CTATGGAAAAATTTTTGTTAACAGCTTTCGCTATGC | 457 |

TABLE 2-continued

Primer list

| No | Name | Primer sequence (5'-3') | SEQ ID NO: |
|---|---|---|---|
| 50 | FIV-env-Y689L-REV | GCATAGCGAAAGCTGTTAACAAAAATTTTCCATAG | 458 |
| 51 | FIV-env-E685F-FOR | GATTAAAAGTAGAAGCTATGTTTAAATTTTTGTATACAGC | 459 |
| 52 | FIV-env-E685F-REV | GCTGTATACAAAAATTTAAACATAGCTTCTACTTTTAATC | 460 |
| 53 | FIV-env-K686F-FOR | GTAGAAGCTATGGAATTTTTTTTGTATACAGCTTTC | 461 |
| 54 | FIV-env-K686F-REV | GAAAGCTGTATACAAAAAAAATTCCATAGCTTCTAC | 462 |
| 55 | FIV-env-L688F-FOR | GCTATGGAAAAATTTTTTTATACAGCTTTCGCTATG | 463 |
| 56 | FIV-env-L688F-REV | CATAGCGAAAGCTGTATAAAAAAATTTTTCCATAGC | 464 |
| 57 | FIV-env-Y689F-FOR | CTATGGAAAAATTTTTGTTTACAGCTTTCGCTATGC | 465 |
| 58 | FIV-env-Y689F-REV | GCATAGCGAAAGCTGTAAACAAAAATTTTTCCATAG | 466 |

Recombinant Proteins:

Recombinant proteins were produced using BL21 (DE3) *Escherichia coli* cells (Stratagene) and pMal-derived expression vectors (New England Biolabs, France). Recombinant WT and mutants TM subunit ectodomains were soluble and were purified on cross-linked Amylose Resin (New England Biolabs, France) packed in column with PBS as a binding and washing buffer and 20 mM Tris-C1, 5 mM maltose, pH 7.5, as an elution buffer. Proteins were then dialysed against phosphate-buffered saline pH 7.4 (PBS), and endotoxins were removed using Endotrap Blue Resin (Hyglos GmbH, Germany) according to manufacturer's protocol.

Establishment of Env-Expressing Tumor Cells and MCA205 Tumor-Rejection Assay:

$7.5 \times 10^5$ 293 T cells were cotransfected with the env-expressing pDFG retroviral vector to be tested (1.75 µg) and expression vectors for the MLV proteins (0.55 µg for the amphotropic MLV env vector and 1.75 µg for the MLV gag and pol vector). 36 hours post-transfection, supernatants were harvested for infection of MCA205 tumor cells (2.5 ml of supernatant per $5 \times 10^5$ cells with 4 µg/ml polybrene). Cells were maintained in selective medium (400 units/ml hygromycin) for 3 weeks, and then washed with PBS, trypsinized and inoculated subcutaneously in the shaved area of each mouse right flank as in Mangeney et al (see above PNAS 1998, PNAS 2007). Tumor growth was monitored by palpation twice or thrice weekly and tumor area (mm²) determined by measuring perpendicular tumor diameters. The extent of "immunosuppression" was quantified by an index based on tumor size: $(A_{env} - A_{none})/A_{none}$, where $A_{env}$ and $A_{none}$ are the mean areas at the peak of growth of tumors from Balb/c mice injected with env-expressing or control cells, respectively.

Analysis of the Antibody Response of Mice Inoculated with MCA205-Transduced Cells Expressing FIV64 Env Wild-Type and Mutants:

the MCA205-transduced cells were also inoculated as above into syngenic mice (C57Bl/6) and sera were collected 1, 2, and 3 weeks after injection. The antibody response against FIV64 env was assayed by ELISA. Briefly, several dilutions of the sera were incubated 1 h at RT on a plate pre-coated with 1 ng/ml of MBP-FIV64, and antibody binding was analysed by using a labeled anti-mouse IgG secondary antibody (GE Healthcare, UK).

Analysis of FIVenv Expression:

$3 \times 10^5$ 293 T cells were transfected with 2 µg of the expression vector for the FIV envelope (phCMV) either wild-type or mutated at the indicated positions using Fugene HD (Roche). Cells were washed 16 h later and then harvested 2 days post-transfection using PBS-EDTA 5 mM. The SU1-30 monoclonal antibody (Antibodies online, BmbH, Germany) was used (1/200 dilution) to stain the FIV envelope. As a secondary antibody, we used the goat anti mouse IgG Alexa 488 (1/400) (Invitrogen). Fluorescence was acquired by flow cytometry using a FACS Calibur (BD Biosciences), and data analysed by the CellQuest software (BD Biosciences).

Cell-Cell Fusion Assays:

For cell-cell fusion assays, $5 \times 10^4$ to $1 \times 10^5$ cells seeded in 24-well plates were transfected by using lipofectamine LTX (Life technologies) with 250 ng of env expression plasmid. Fusion activity of each envelope protein was visualized 24 to 48 h after transfection by May-Grunwald and Giemsa staining, according to the manufacturer's instructions (Sigma). The fusion index, which represents the percentage of fusion events in a cell population, is defined as $[(N-S)/T] \times 100$, where N is the number of nuclei in the syncytia, S is the number of syncytia, and T is the total number of nuclei counted

SEQUENCE LISTING (502 sequences)

SEQ ID NO: 1 - protein, 9 aa, Artificial sequence
  Mutated sequence
  MISC_FEATURE (2)..(2): Xaa is Ile or Met or Thr or Leu
  MISC_FEATURE (3)..(7): Xaa is any natural occurring amino acid or is mutated
AXXXXXXTA

SEQ ID NO: 2 - protein, 17 aa, FIV
  MISC_FEATURE (3)..(3): Xaa is Lys or Thr or Arg
  MISC_FEATURE (4)..(4): Xaa is Val or Ile
  MISC_FEATURE (5)..(5): Xaa is Glu or Arg
  MISC_FEATURE (7)..(7): Xaa is Ile or Met or Thr or Leu
  MISC_FEATURE (10)..(10): Xaa is Phe or Pro
  MISC_FEATURE (11)..(11): Xaa is Leu or Val or Ile
  MISC_FEATURE (15)..(15): Xaa is Phe or Leu
GLXXXAXEKXXYTAXAM

SEQ ID NO: 3 - protein, 14 aa, Artificial sequence
  Mutated sequence
  MISC_FEATURE (1)..(1): Xaa is Val or Ile
  MISC_FEATURE (2)..(2): Xaa is Glu or Arg
  MISC_FEATURE (4)..(4): Xaa is Ile or Met or Thr or leu
  MISC_FEATURE (5)..(9): Xaa is any naturally occurring amino acid or is mutated
  MISC_FEATURE (12)..(12): Xaa is Phe or leu
XXAXXXXXXTAXAM

SEQ ID NO: 4 - protein, 856 aa, FIV
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 5 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKRLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 6 - protein, 64 aa, FIV
AIEKVTGALKINNLRLVTLEHQVLVIGLKVEAMEKFLYTAFAMQELGCNQNQFFCKIPLELWTR

SEQ ID NO: 7 - protein, 64 aa, FIV
AVEKVTEALKINNLRLVTLEHQVLVIGLKVEAMEKFLYTAFAMQELGCNQNQFFCKIPPELWTR

SEQ ID NO: 8 - protein, 64 aa, FIV
AIEKVTEALKITNLRLVTLEHQVLVIGLKVEAMEKFLYTAFAMQELGCNQNQFFCKVPPELWRR

SEQ ID NO: 9 - protein, 64 aa, FIV
AIEKVTEALKINNLRLVTLEHQVLVIGLKVEAIEKFLYTAFAMQELGCNQNQFFCKVPLELWRR

SEQ ID NO: 10 - protein, 64 aa, FIV
AIEKVTEALKINNLRLVTLEHQVLVIGLKVEAMEKFLYTAFAMQELGCNQNQFFCKVPSALWER

SEQ ID NO: 11 - protein, 64 aa, FIV
AIEKVTEALKINNLRLVTLEHQVLVIGLKVEAMEKFLYTAFAMQELGCNQNQFFCKIPPGLWTR

SEQ ID NO: 12 - protein, 64 aa, FIV
AIEKVTEALKINNLRLVTLEHQVLVIGLKVEAMEKFLYTAFAMQELGCNQNQFFCKVPPQLWKR

SEQ ID NO: 13 - protein, 64 aa, FIV
AIEKVTEALKVNNLRLITLEHQVLVIGLKVEAMEKFLYTAFAMQELGCNQNQFFCKVPPELWKR

SEQ ID NO: 14 - protein, 64 aa, FIV
TIEKVTEALKINNLRLVTLEHQVLVIGLKVEAMEKFLYTAFAMQELGCNQNQFFCKVPPELWKR

SEQ ID NO: 15 - protein, 64 aa, FIV
AIEKVTEALKINNLRLVTLEHQVLVIGLKVEAMEKFLYTAFAMQELGCNQNQFFCKVPPVLWER

SEQ ID NO: 16 - protein, 64 aa, FIV
TIEKITEALKVNNLRLVTLEHQVLVIGLKVEAIEKFLYTAFAMQELGCNQNQFFCKVPPELWQR

SEQ ID NO: 17 - protein, 64 aa, FIV
AIDQITEALKINNLRLVTLEHQVLVIGLKVEAIEKFIYTAFAMQELGCNQNQFFCKIPPELWIR

SEQ ID NO: 18 - protein, 64 aa, FIV
ALDKITEALKINNLRLITLEHQVLVIGLKVEAIEKFLYTAFAMQELGCNQNQFFCKIPPSLWSM

SEQ ID NO: 19 - protein, 64 aa, FIV
ALDKITEALKINNLRLVTLEHQVLVIGLKVEATEKFLYTAFAMQELGCNQNQFFCKIPCELWMR

SEQ ID NO: 20 - protein, 64 aa, FIV
ALEKITEALKINNLRLVTLEHQVLMIGLKVEAIEKFLYTAFAMQELGCNQNQFFCKIPLNLWTM

SEQ ID NO: 21 - protein, 64 aa, FIV
ALDKITEALKINNLRLITLVHQVLVIGLKVRAIEKPLYTAFAMQELGCNQNQFFCKIPPSLWSM

SEQ ID NO: 22 - protein, 64 aa, FIV
ALEKITEALKINNLRLITLEHQVLVIGLRVEAIEKFLYTAFAMQELGCNQNQFFCKIPPSLWSM

SEQ ID NO: 23 - protein, 64 aa, FIV
ALEKITEALKINNLRLITLEHQVLVIGLKVEAIEKFLYTAFAMQELGCHQNQFFCKIPPSLWSM

SEQ ID NO: 24 - protein, 64 aa, FIV; identical to SEQ ID NO: 18

SEQ ID NO: 25 - protein, 64 aa, FIV
ALDKITQALKINNLRLITLEHQVLVIGLKVEAIEKFLYTAFAMQELGCNQNQFFCKIPPSLWSM

SEQ ID NO: 26 - protein, 64 aa, FIV
ALDKITEALKINNLRLITLEHQVLVIGLKVEAIEKFLYTAFAMQELGCNQNQFFCKIPLNLWNM

SEQ ID NO: 27 - protein, 64 aa, FIV
ALDKITEALKINNLRLVTLEHQMLVIGLKVEAIEKFLYTAFAMQELGCNQNQFFCEIPKELWLR

SEQ ID NO: 28 - protein, 9 aa, Artificial sequence
  Mutated sequence
AIEKRLYTA

SEQ ID NO: 29 - protein, 9 aa, Artificial sequence
  Mutated sequence
AMEKRLYTA

SEQ ID NO: 30 - protein, 9 aa, Artificial sequence
  Mutated sequence
ATEKRLYTA

SEQ ID NO: 31 - protein, 9 aa, Artificial sequence
  Mutated sequence
ALEKRLYTA

SEQ ID NO: 32 - protein, 9 aa, Artificial sequence
  Mutated sequence
AIEKRVYTA

SEQ ID NO: 33 - protein, 9 aa, Artificial sequence
  Mutated sequence
AMEKRVYTA

SEQ ID NO: 34 - protein, 9 aa, Artificial sequence
  Mutated sequence
ATEKRVYTA

SEQ ID NO: 35 - protein, 9 aa, Artificial sequence
  Mutated sequence
ALEKRVYTA

SEQ ID NO: 36 - protein, 9 aa, Artificial sequence
  Mutated sequence
AIEKRIYTA

SEQ ID NO: 37 - protein, 9 aa, Artificial sequence
  Mutated sequence
AMEKRIYTA

SEQ ID NO: 38 - protein, 9 aa, Artificial sequence
  Mutated sequence
ATEKRIYTA

SEQ ID NO: 39 - protein, 9 aa, Artificial sequence
  Mutated sequence
ALEKRIYTA

SEQ ID NO: 40 - protein, 9 aa, Artificial sequence
  Mutated sequence
AIEKGLYTA

SEQ ID NO: 41 - protein, 9 aa, Artificial sequence
  Mutated sequence
AMEKGLYTA

SEQ ID NO: 42 - protein, 9 aa, Artificial sequence
  Mutated sequence
ATEKGLYTA

SEQ ID NO: 43 - protein, 9 aa, Artificial sequence
  Mutated sequence
ALEKGLYTA

SEQ ID NO: 44 - protein, 9 aa, Artificial sequence
  Mutated sequence
AIEKGVYTA

SEQ ID NO: 45 - protein, 9 aa, Artificial sequence
  Mutated sequence
AMEKGVYTA

SEQ ID NO: 46 - protein, 9 aa, Artificial sequence
  Mutated sequence
ATEKGVYTA

SEQ ID NO: 47 - protein, 9 aa, Artificial sequence
  Mutated sequence
ALEKGVYTA

SEQ ID NO: 48 - protein, 9 aa, Artificial sequence
  Mutated sequence
AIEKGIYTA

SEQ ID NO: 49 - protein, 9 aa, Artificial sequence
  Mutated sequence
AMEKGIYTA

SEQ ID NO: 50 - protein, 9 aa, Artificial sequence
  Mutated sequence
ATEKGIYTA

SEQ ID NO: 51 - protein, 9 aa, Artificial sequence
  Mutated sequence
ALEKGIYTA

SEQ ID NO: 52 - protein, 9 aa, Artificial sequence
  Mutated sequence
AIEKLLYTA

SEQ ID NO: 53 - protein, 9 aa, Artificial sequence
  Mutated sequence
AMEKLLYTA

SEQ ID NO: 54 - protein, 9 aa, Artificial sequence
  Mutated sequence
ATEKLLYTA

SEQ ID NO: 55 - protein, 9 aa, Artificial sequence
  Mutated sequence
ALEKLLYTA

SEQ ID NO: 56 - protein, 9 aa, Artificial sequence
  Mutated sequence
AIEKLVYTA

SEQ ID NO: 57 - protein, 9 aa, Artificial sequence
  Mutated sequence
AMEKLVYTA

SEQ ID NO: 58 - protein, 9 aa, Artificial sequence
  Mutated sequence
ATEKLVYTA

SEQ ID NO: 59 - protein, 9 aa, Artificial sequence
  Mutated sequence
ALEKLVYTA

SEQ ID NO: 60 - protein, 9 aa, Artificial sequence
  Mutated sequence
AIEKLIYTA

SEQ ID NO: 61 - protein, 9 aa, Artificial sequence
  Mutated sequence
AMEKLIYTA

SEQ ID NO: 62 - protein, 9 aa, Artificial sequence
  Mutated sequence
ATEKLIYTA

SEQ ID NO: 63 - protein, 9 aa, Artificial sequence
  Mutated sequence
ALEKLIYTA

SEQ ID NO: 64 - protein, 9 aa, Artificial sequence
  Mutated sequence
AIEKALYTA

SEQ ID NO: 65 - protein, 9 aa, Artificial sequence
  Mutated sequence
AMEKALYTA

SEQ ID NO: 66 - protein, 9 aa, Artificial sequence
  Mutated sequence
ATEKALYTA

SEQ ID NO: 67 - protein, 9 aa, Artificial sequence
  Mutated sequence
ALEKALYTA

SEQ ID NO: 68 - protein, 9 aa, Artificial sequence
  Mutated sequence
AIEKAVYTA

SEQ ID NO: 69 - protein, 9 aa, Artificial sequence
  Mutated sequence
AMEKAVYTA

SEQ ID NO: 70 - protein, 9 aa, Artificial sequence
  Mutated sequence
ATEKAVYTA

SEQ ID NO: 71 - protein, 9 aa, Artificial sequence
  Mutated sequence
ALEKAVYTA

SEQ ID NO: 72 - protein, 9 aa, Artificial sequence
  Mutated sequence
AIEKAIYTA

SEQ ID NO: 73 - protein, 9 aa, Artificial sequence
  Mutated sequence
AMEKAIYTA

SEQ ID NO: 74 - protein, 9 aa, Artificial sequence
  Mutated sequence
ATEKAIYTA

SEQ ID NO: 75 - protein, 9 aa, Artificial sequence
  Mutated sequence
ALEKAIYTA

SEQ ID NO: 76 - protein, 9 aa, Artificial sequence
  Mutated sequence
AIEKFRYTA

SEQ ID NO: 77 - protein, 9 aa, Artificial sequence
  Mutated sequence
AMEKFRYTA

SEQ ID NO: 78 - protein, 9 aa, Artificial sequence
  Mutated sequence
ATEKFRYTA

SEQ ID NO: 79 - protein, 9 aa, Artificial sequence
  Mutated sequence
ALEKFRYTA

SEQ ID NO: 80 - protein, 9 aa, Artificial sequence
  Mutated sequence
AIEKPRYTA

SEQ ID NO: 81 - protein, 9 aa, Artificial sequence
  Mutated sequence
AMEKPRYTA

SEQ ID NO: 82 - protein, 9 aa, Artificial sequence
  Mutated sequence
ATEKPRYTA

SEQ ID NO: 83 - protein, 9 aa, Artificial sequence
  Mutated sequence
ALEKPRYTA

SEQ ID NO: 84 - protein, 9 aa, Artificial sequence
  Mutated sequence
AIEKFGYTA

SEQ ID NO: 85 - protein, 9 aa, Artificial sequence
  Mutated sequence
AMEKFGYTA

SEQ ID NO: 86 - protein, 9 aa, Artificial sequence
  Mutated sequence
ATEKFGYTA

SEQ ID NO: 87 - protein, 9 aa, Artificial sequence
  Mutated sequence
ALEKFGYTA

SEQ ID NO: 88 - protein, 9 aa, Artificial sequence
  Mutated sequence
AIEKPGYTA

SEQ ID NO: 89 - protein, 9 aa, Artificial sequence
  Mutated sequence
AMEKPGYTA

SEQ ID NO: 90 - protein, 9 aa, Artificial sequence
  Mutated sequence
ATEKPGYTA

SEQ ID NO: 91 - protein, 9 aa, Artificial sequence
  Mutated sequence
ALEKPGYTA

SEQ ID NO: 92 - protein, 9 aa, Artificial sequence
  Mutated sequence
AIEKFFYTA

SEQ ID NO: 93 - protein, 9 aa, Artificial sequence
  Mutated sequence
AMEKFFYTA

SEQ ID NO: 94 - protein, 9 aa, Artificial sequence
  Mutated sequence
ATEKFFYTA

SEQ ID NO: 95 - protein, 9 aa, Artificial sequence
  Mutated sequence
ALEKFFYTA

SEQ ID NO: 96 - protein, 9 aa, Artificial sequence
  Mutated sequence
AIEKPFYTA

SEQ ID NO: 97 - protein, 9 aa, Artificial sequence
  Mutated sequence
AMEKPFYTA

SEQ ID NO: 98 - protein, 9 aa, Artificial sequence
  Mutated sequence
ATEKPFYTA

SEQ ID NO: 99 - protein, 9 aa, Artificial sequence
  Mutated sequence
ALEKPFYTA

SEQ ID NO: 100 - protein, 9 aa, Artificial sequence
  Mutated sequence
AIEKFAYTA

SEQ ID NO: 101 - protein, 9 aa, Artificial sequence
  Mutated sequence
AMEKFAYTA

SEQ ID NO: 102 - protein, 9 aa, Artificial sequence
  Mutated sequence
ATEKFAYTA

SEQ ID NO: 103 - protein, 9 aa, Artificial sequence
  Mutated sequence
ALEKFAYTA

SEQ ID NO: 104 - protein, 9 aa, Artificial sequence
  Mutated sequence
AIEKPAYTA

SEQ ID NO: 105 - protein, 9 aa, Artificial sequence
  Mutated sequence
AMEKPAYTA

SEQ ID NO: 106 - protein, 9 aa, Artificial sequence
  Mutated sequence
ATEKPAYTA

SEQ ID NO: 107 - protein, 9 aa, Artificial sequence
  Mutated sequence
ALEKPAYTA

SEQ ID NO: 108 - protein, 9 aa, Artificial sequence
  Mutated sequence
AIEKRRYTA

SEQ ID NO: 109 - protein, 9 aa, Artificial sequence
  Mutated sequence
AMEKRRYTA

SEQ ID NO: 110 - protein, 9 aa, Artificial sequence
  Mutated sequence
ATEKRRYTA

SEQ ID NO: 111 - protein, 9 aa, Artificial sequence
  Mutated sequence
ALEKRRYTA

SEQ ID NO: 112 - protein, 9 aa, Artificial sequence
  Mutated sequence
AIEKRAYTA

SEQ ID NO: 113 - protein, 9 aa, Artificial sequence
  Mutated sequence
AMEKRAYTA

SEQ ID NO: 114 - protein, 9 aa, Artificial sequence
  Mutated sequence
ATEKRAYTA

SEQ ID NO: 115 - protein, 9 aa, Artificial sequence
  Mutated sequence
ALEKRAYTA

SEQ ID NO: 116 - protein, 9 aa, Artificial sequence
  Mutated sequence
AIEKRFYTA

SEQ ID NO: 117 - protein, 9 aa, Artificial sequence
  Mutated sequence
AMEKRFYTA

SEQ ID NO: 118 - protein, 9 aa, Artificial sequence
  Mutated sequence
ATEKRFYTA

SEQ ID NO: 119 - protein, 9 aa, Artificial sequence
  Mutated sequence
ALEKRFYTA

SEQ ID NO: 120 - protein, 9 aa, Artificial sequence
  Mutated sequence
AIEKRGYTA

SEQ ID NO: 121 - protein, 9 aa, Artificial sequence
  Mutated sequence
AMEKRGYTA

SEQ ID NO: 122 - protein, 9 aa, Artificial sequence
  Mutated sequence
ATEKRGYTA

SEQ ID NO: 123 - protein, 9 aa, Artificial sequence
  Mutated sequence
ALEKRGYTA

SEQ ID NO: 124 - protein, 9 aa, Artificial sequence
  Mutated sequence
AIEKARYTA

SEQ ID NO: 125 - protein, 9 aa, Artificial sequence
  Mutated sequence
AMEKARYTA

SEQ ID NO: 126 - protein, 9 aa, Artificial sequence
  Mutated sequence
ATEKARYTA

SEQ ID NO: 127 - protein, 9 aa, Artificial sequence
  Mutated sequence
ALEKARYTA

SEQ ID NO: 128 - protein, 9 aa, Artificial sequence
  Mutated sequence
AIEKAAYTA

SEQ ID NO: 129 - protein, 9 aa, Artificial sequence
  Mutated sequence
AMEKAAYTA

SEQ ID NO: 130 - protein, 9 aa, Artificial sequence
  Mutated sequence
ATEKAAYTA

SEQ ID NO: 131 - protein, 9 aa, Artificial sequence
  Mutated sequence
ALEKAAYTA

SEQ ID NO: 132 - protein, 9 aa, Artificial sequence
  Mutated sequence
AIEKAFYTA

SEQ ID NO: 133 - protein, 9 aa, Artificial sequence
  Mutated sequence
AMEKAFYTA

SEQ ID NO: 134 - protein, 9 aa, Artificial sequence
  Mutated sequence
ATEKAFYTA

SEQ ID NO: 135 - protein, 9 aa, Artificial sequence
  Mutated sequence
ALEKAFYTA

SEQ ID NO: 136 - protein, 9 aa, Artificial sequence
  Mutated sequence
AIEKAGYTA

SEQ ID NO: 137 - protein, 9 aa, Artificial sequence
  Mutated sequence
AMEKAGYTA

SEQ ID NO: 138 - protein, 9 aa, Artificial sequence
  Mutated sequence
ATEKAGYTA

SEQ ID NO: 139 - protein, 9 aa, Artificial sequence
  Mutated sequence
ALEKAGYTA

SEQ ID NO: 140 - protein, 9 aa, Artificial sequence
  Mutated sequence
AIEKGRYTA

SEQ ID NO: 141 - protein, 9 aa, Artificial sequence
  Mutated sequence
AMEKGRYTA

SEQ ID NO: 142 - protein, 9 aa, Artificial sequence
  Mutated sequence
ATEKGRYTA

SEQ ID NO: 143 - protein, 9 aa, Artificial sequence
  Mutated sequence
ALEKGRYTA

SEQ ID NO: 144 - protein, 9 aa, Artificial sequence
  Mutated sequence
AIEKGAYTA

SEQ ID NO: 145 - protein, 9 aa, Artificial sequence
  Mutated sequence
AMEKGAYTA

SEQ ID NO: 146 - protein, 9 aa, Artificial sequence
  Mutated sequence
ATEKGAYTA

SEQ ID NO: 147 - protein, 9 aa, Artificial sequence
  Mutated sequence
ALEKGAYTA

SEQ ID NO: 148 - protein, 9 aa, Artificial sequence
  Mutated sequence
AIEKGFYTA

SEQ ID NO: 149 - protein, 9 aa, Artificial sequence
  Mutated sequence
AMEKGFYTA

SEQ ID NO: 150 - protein, 9 aa, Artificial sequence
  Mutated sequence
ATEKGFYTA

SEQ ID NO: 151 - protein, 9 aa, Artificial sequence
  Mutated sequence
ALEKGFYTA

SEQ ID NO: 152 - protein, 9 aa, Artificial sequence
  Mutated sequence
AIEKGGYTA

SEQ ID NO: 153 - protein, 9 aa, Artificial sequence
  Mutated sequence
AMEKGGYTA

SEQ ID NO: 154 - protein, 9 aa, Artificial sequence
  Mutated sequence
ATEKGGYTA

SEQ ID NO: 155 - protein, 9 aa, Artificial sequence
  Mutated sequence
ALEKGGYTA

SEQ ID NO: 156 - protein, 9 aa, Artificial sequence
  Mutated sequence
AIEKFRYTA

SEQ ID NO: 157 - protein, 9 aa, Artificial sequence
  Mutated sequence
AMEKFRYTA

SEQ ID NO: 158 - protein, 9 aa, Artificial sequence
  Mutated sequence
ATEKFRYTA

SEQ ID NO: 159 - protein, 9 aa, Artificial sequence
  Mutated sequence
ALEKFRYTA

SEQ ID NO: 160 - protein, 9 aa, Artificial sequence
  Mutated sequence
AIEKFAYTA

SEQ ID NO: 161 - protein, 9 aa, Artificial sequence
  Mutated sequence
AMEKFAYTA

SEQ ID NO: 162 - protein, 9 aa, Artificial sequence
  Mutated sequence
ATEKFAYTA

SEQ ID NO: 163 - protein, 9 aa, Artificial sequence
  Mutated sequence
ALEKFAYTA

SEQ ID NO: 164 - protein, 9 aa, Artificial sequence
  Mutated sequence
AIEKFFYTA

SEQ ID NO: 165 - protein, 9 aa, Artificial sequence
  Mutated sequence
AMEKFFYTA

SEQ ID NO: 166 - protein, 9 aa, Artificial sequence
  Mutated sequence
ATEKFFYTA

SEQ ID NO: 167 - protein, 9 aa, Artificial sequence
  Mutated sequence
ALEKFFYTA

SEQ ID NO: 168 - protein, 9 aa, Artificial sequence
  Mutated sequence
AIEKFGYTA

SEQ ID NO: 169 - protein, 9 aa, Artificial sequence
  Mutated sequence
AMEKFGYTA

SEQ ID NO: 170 - protein, 9 aa, Artificial sequence
  Mutated sequence
ATEKFGYTA

SEQ ID NO: 171 - protein, 9 aa, Artificial sequence
  Mutated sequence
ALEKFGYTA

SEQ ID NO: 172 - protein, 64 aa, Artificial sequence
  Mutated sequence
AIEKVTGALKINNLRLVTLEHQVLVIGLKVEAIEKRLYTAFAMQELGCNQNQFFCKIPLELWTR

SEQ ID NO: 173 - protein, 64 aa, Artificial sequence
  Mutated sequence
AIEKVTGALKINNLRLVTLEHQVLVIGLKVEAMEKRLYTAFAMQELGCNQNQFFCKIPLELWTR

SEQ ID NO: 174 - protein, 64 aa, Artificial sequence
  Mutated sequence
AIEKVTGALKINNLRLVTLEHQVLVIGLKVEATEKRLYTAFAMQELGCNQNQFFCKIPLELWTR

SEQ ID NO: 175 - protein, 64 aa, Artificial sequence
  Mutated sequence
AIEKVTGALKINNLRLVTLEHQVLVIGLKVEALEKRLYTAFAMQELGCNQNQFFCKIPLELWTR

SEQ ID NO: 176 - protein, 64 aa, Artificial sequence
  Mutated sequence
AIEKVTGALKINNLRLVTLEHQVLVIGLKVEAIEKRVYTAFAMQELGCNQNQFFCKIPLELWTR

SEQ ID NO: 177 - protein, 64 aa, Artificial sequence
  Mutated sequence
AIEKVTGALKINNLRLVTLEHQVLVIGLKVEAMEKRVYTAFAMQELGCNQNQFFCKIPLELWTR

SEQ ID NO: 178 - protein, 64 aa, Artificial sequence
  Mutated sequence
AIEKVTGALKINNLRLVTLEHQVLVIGLKVEATEKRVYTAFAMQELGCNQNQFFCKIPLELWTR

SEQ ID NO: 179 - protein, 64 aa, Artificial sequence
  Mutated sequence
AIEKVTGALKINNLRLVTLEHQVLVIGLKVEALEKRVYTAFAMQELGCNQNQFFCKIPLELWTR

SEQ ID NO: 180 - protein, 64 aa, Artificial sequence
  Mutated sequence
AIEKVTGALKINNLRLVTLEHQVLVIGLKVEAIEKRIYTAFAMQELGCNQNQFFCKIPLELWTR

SEQ ID NO: 181 - protein, 64 aa, Artificial sequence
  Mutated sequence
AIEKVTGALKINNLRLVTLEHQVLVIGLKVEAMEKRIYTAFAMQELGCNQNQFFCKIPLELWTR

SEQ ID NO: 182 - protein, 64 aa, Artificial sequence
  Mutated sequence
AIEKVTGALKINNLRLVTLEHQVLVIGLKVEATEKRIYTAFAMQELGCNQNQFFCKIPLELWTR

SEQ ID NO: 183 - protein, 64 aa, Artificial sequence
  Mutated sequence
AIEKVTGALKINNLRLVTLEHQVLVIGLKVEALEKRIYTAFAMQELGCNQNQFFCKIPLELWTR

SEQ ID NO: 184 - protein, 64 aa, Artificial sequence
  Mutated sequence
AIEKVTGALKINNLRLVTLEHQVLVIGLKVEAIEKGLYTAFAMQELGCNQNQFFCKIPLELWTR

SEQ ID NO: 185 - protein, 64 aa, Artificial sequence
  Mutated sequence
AIEKVTGALKINNLRLVTLEHQVLVIGLKVEAMEKGLYTAFAMQELGCNQNQFFCKIPLELWTR

SEQ ID NO: 186 - protein, 64 aa, Artificial sequence
  Mutated sequence
AIEKVTGALKINNLRLVTLEHQVLVIGLKVEATEKGLYTAFAMQELGCNQNQFFCKIPLELWTR

SEQ ID NO: 187 - protein, 64 aa, Artificial sequence
  Mutated sequence
AIEKVTGALKINNLRLVTLEHQVLVIGLKVEALEKGLYTAFAMQELGCNQNQFFCKIPLELWTR

SEQ ID NO: 188 - protein, 64 aa, Artificial sequence
  Mutated sequence
AIEKVTGALKINNLRLVTLEHQVLVIGLKVEAIEKGVYTAFAMQELGCNQNQFFCKIPLELWTR

SEQ ID NO: 189 - protein, 64 aa, Artificial sequence
  Mutated sequence
AAIEKVTGALKINNLRLVTLEHQVLVIGLKVEMEKGVYTAFAMQELGCNQNQFFCKIPLELWTR

SEQ ID NO: 190 - protein, 64 aa, Artificial sequence
  Mutated sequence
AIEKVTGALKINNLRLVTLEHQVLVIGLKVEATEKGVYTAFAMQELGCNQNQFFCKIPLELWTR

SEQ ID NO: 191 - protein, 64 aa, Artificial sequence
  Mutated sequence
AIEKVTGALKINNLRLVTLEHQVLVIGLKVEALEKGVYTAFAMQELGCNQNQFFCKIPLELWTR

SEQ ID NO: 192 - protein, 64 aa, Artificial sequence
  Mutated sequence
AIEKVTGALKINNLRLVTLEHQVLVIGLKVEAIEKGIYTAFAMQELGCNQNQFFCKIPLELWTR

SEQ ID NO: 193 - protein, 64 aa, Artificial sequence
  Mutated sequence
AIEKVTGALKINNLRLVTLEHQVLVIGLKVEAMEKGIYTAFAMQELGCNQNQFFCKIPLELWTR

SEQ ID NO: 194 - protein, 64 aa, Artificial sequence
  Mutated sequence
AIEKVTGALKINNLRLVTLEHQVLVIGLKVEATEKGIYTAFAMQELGCNQNQFFCKIPLELWTR

SEQ ID NO: 195 - protein, 64 aa, Artificial sequence
  Mutated sequence
AIEKVTGALKINNLRLVTLEHQVLVIGLKVEALEKGIYTAFAMQELGCNQNQFFCKIPLELWTR

SEQ ID NO: 196 - protein, 64 aa, Artificial sequence
  Mutated sequence
AIEKVTGALKINNLRLVTLEHQVLVIGLKVEAIEKLLYTAFAMQELGCNQNQFFCKIPLELWTR

SEQ ID NO: 197 - protein, 64 aa, Artificial sequence
  Mutated sequence
AIEKVTGALKINNLRLVTLEHQVLVIGLKVEAMEKLLYTAFAMQELGCNQNQFFCKIPLELWTR

SEQ ID NO: 198 - protein, 64 aa, Artificial sequence
  Mutated sequence
AIEKVTGALKINNLRLVTLEHQVLVIGLKVEATEKLLYTAFAMQELGCNQNQFFCKIPLELWTR

SEQ ID NO: 199 - protein, 64 aa, Artificial sequence
  Mutated sequence
AIEKVTGALKINNLRLVTLEHQVLVIGLKVEALEKLLYTAFAMQELGCNQNQFFCKIPLELWTR

SEQ ID NO: 200 - protein, 64 aa, Artificial sequence
  Mutated sequence
AIEKVTGALKINNLRLVTLEHQVLVIGLKVEAIEKLVYTAFAMQELGCNQNQFFCKIPLELWTR

SEQ ID NO: 201 - protein, 64 aa, Artificial sequence
  Mutated sequence
AIEKVTGALKINNLRLVTLEHQVLVIGLKVEAMEKLVYTAFAMQELGCNQNQFFCKIPLELWTR

SEQ ID NO: 202 - protein, 64 aa, Artificial sequence
  Mutated sequence
AIEKVTGALKINNLRLVTLEHQVLVIGLKVEATEKLVYTAFAMQELGCNQNQFFCKIPLELWTR

SEQ ID NO: 203 - protein, 64 aa, Artificial sequence
  Mutated sequence
AIEKVTGALKINNLRLVTLEHQVLVIGLKVEALEKLVYTAFAMQELGCNQNQFFCKIPLELWTR

SEQ ID NO: 204 - protein, 64 aa, Artificial sequence
  Mutated sequence
AIEKVTGALKINNLRLVTLEHQVLVIGLKVEAIEKLIYTAFAMQELGCNQNQFFCKIPLELWTR

SEQ ID NO: 205 - protein, 64 aa, Artificial sequence
  Mutated sequence
AIEKVTGALKINNLRLVTLEHQVLVIGLKVEAMEKLIYTAFAMQELGCNQNQFFCKIPLELWTR

SEQ ID NO: 206 - protein, 64 aa, Artificial sequence
  Mutated sequence
AIEKVTGALKINNLRLVTLEHQVLVIGLKVEATEKLIYTAFAMQELGCNQNQFFCKIPLELWTR

SEQ ID NO: 207 - protein, 64 aa, Artificial sequence
  Mutated sequence
AIEKVTGALKINNLRLVTLEHQVLVIGLKVEALEKLIYTAFAMQELGCNQNQFFCKIPLELWTR

SEQ ID NO: 208 - protein, 64 aa, Artificial sequence
  Mutated sequence
AIEKVTGALKINNLRLVTLEHQVLVIGLKVEAIEKALYTAFAMQELGCNQNQFFCKIPLELWTR

SEQ ID NO: 209 - protein, 64 aa, Artificial sequence
  Mutated sequence
AIEKVTGALKINNLRLVTLEHQVLVIGLKVEAMEKALYTAFAMQELGCNQNQFFCKIPLELWTR

SEQ ID NO: 210 - protein, 64 aa, Artificial sequence
  Mutated sequence
AIEKVTGALKINNLRLVTLEHQVLVIGLKVEATEKALYTAFAMQELGCNQNQFFCKIPLELWTR

SEQ ID NO: 211 - protein, 64 aa, Artificial sequence
  Mutated sequence
AIEKVTGALKINNLRLVTLEHQVLVIGLKVEALEKALYTAFAMQELGCNQNQFFCKIPLELWTR

SEQ ID NO: 212 - protein, 64 aa, Artificial sequence
  Mutated sequence
AIEKVTGALKINNLRLVTLEHQVLVIGLKVEAIEKAVYTAFAMQELGCNQNQFFCKIPLELWTR

SEQ ID NO: 213 - protein, 64 aa, Artificial sequence
  Mutated sequence
AIEKVTGALKINNLRLVTLEHQVLVIGLKVEAMEKAVYTAFAMQELGCNQNQFFCKIPLELWTR

SEQ ID NO: 214 - protein, 64 aa, Artificial sequence
  Mutated sequence
AIEKVTGALKINNLRLVTLEHQVLVIGLKVEATEKAVYTAFAMQELGCNQNQFFCKIPLELWTR

SEQ ID NO: 215 - protein, 64 aa, Artificial sequence
  Mutated sequence
AIEKVTGALKINNLRLVTLEHQVLVIGLKVEALEKAVYTAFAMQELGCNQNQFFCKIPLELWTR

SEQ ID NO: 216 - protein, 64 aa, Artificial sequence
  Mutated sequence
AIEKVTGALKINNLRLVTLEHQVLVIGLKVEAIEKAIYTAFAMQELGCNQNQFFCKIPLELWTR

SEQ ID NO: 217 - protein, 64 aa, Artificial sequence
  Mutated sequence
AIEKVTGALKINNLRLVTLEHQVLVIGLKVEAMEKAIYTAFAMQELGCNQNQFFCKIPLELWTR

SEQ ID NO: 218 - protein, 64 aa, Artificial sequence
  Mutated sequence
AIEKVTGALKINNLRLVTLEHQVLVIGLKVEATEKAIYTAFAMQELGCNQNQFFCKIPLELWTR

SEQ ID NO: 219 - protein, 64 aa, Artificial sequence
  Mutated sequence
AIEKVTGALKINNLRLVTLEHQVLVIGLKVEALEKAIYTAFAMQELGCNQNQFFCKIPLELWTR

SEQ ID NO: 220 - protein, 64 aa, Artificial sequence
  Mutated sequence
AIEKVTGALKINNLRLVTLEHQVLVIGLKVEAIEKFRYTAFAMQELGCNQNQFFCKIPLELWTR

SEQ ID NO: 221 - protein, 64 aa, Artificial sequence
  Mutated sequence
AIEKVTGALKINNLRLVTLEHQVLVIGLKVEAMEKFRYTAFAMQELGCNQNQFFCKIPLELWTR

SEQ ID NO: 222 - protein, 64 aa, Artificial sequence
  Mutated sequence
AIEKVTGALKINNLRLVTLEHQVLVIGLKVEATEKFRYTAFAMQELGCNQNQFFCKIPLELWTR

SEQ ID NO: 223 - protein, 64 aa, Artificial sequence
  Mutated sequence
AIEKVTGALKINNLRLVTLEHQVLVIGLKVEALEKFRYTAFAMQELGCNQNQFFCKIPLELWTR

SEQ ID NO: 224 - protein, 64 aa, Artificial sequence
  Mutated sequence
AIEKVTGALKINNLRLVTLEHQVLVIGLKVEAIEKPRYTAFAMQELGCNQNQFFCKIPLELWTR

SEQ ID NO: 225 - protein, 64 aa, Artificial sequence
  Mutated sequence
AIEKVTGALKINNLRLVTLEHQVLVIGLKVEAMEKPRYTAFAMQELGCNQNQFFCKIPLELWTR

SEQ ID NO: 226 - protein, 64 aa, Artificial sequence
  Mutated sequence
AIEKVTGALKINNLRLVTLEHQVLVIGLKVEATEKPRYTAFAMQELGCNQNQFFCKIPLELWTR

SEQ ID NO: 227 - protein, 64 aa, Artificial sequence
  Mutated sequence
AIEKVTGALKINNLRLVTLEHQVLVIGLKVEALEKPRYTAFAMQELGCNQNQFFCKIPLELWTR

SEQ ID NO: 228 - protein, 64 aa, Artificial sequence
  Mutated sequence
AIEKVTGALKINNLRLVTLEHQVLVIGLKVEAIEKFGYTAFAMQELGCNQNQFFCKIPLELWTR

SEQ ID NO: 229 - protein, 64 aa, Artificial sequence
  Mutated sequence
AIEKVTGALKINNLRLVTLEHQVLVIGLKVEAMEKFGYTAFAMQELGCNQNQFFCKIPLELWTR

SEQ ID NO: 230 - protein, 64 aa, Artificial sequence
  Mutated sequence
AIEKVTGALKINNLRLVTLEHQVLVIGLKVEATEKFGYTAFAMQELGCNQNQFFCKIPLELWTR

SEQ ID NO: 231 - protein, 64 aa, Artificial sequence
  Mutated sequence
AIEKVTGALKINNLRLVTLEHQVLVIGLKVEALEKFGYTAFAMQELGCNQNQFFCKIPLELWTR

SEQ ID NO: 232 - protein, 64 aa, Artificial sequence
  Mutated sequence
AIEKVTGALKINNLRLVTLEHQVLVIGLKVEAIEKPGYTAFAMQELGCNQNQFFCKIPLELWTR

SEQ ID NO: 233 - protein, 64 aa, Artificial sequence
  Mutated sequence
AIEKVTGALKINNLRLVTLEHQVLVIGLKVEAMEKPGYTAFAMQELGCNQNQFFCKIPLELWTR

SEQ ID NO: 234 - protein, 64 aa, Artificial sequence
  Mutated sequence
AIEKVTGALKINNLRLVTLEHQVLVIGLKVEATEKPGYTAFAMQELGCNQNQFFCKIPLELWTR

SEQ ID NO: 235 - protein, 64 aa, Artificial sequence
  Mutated sequence
AIEKVTGALKINNLRLVTLEHQVLVIGLKVEALEKPGYTAFAMQELGCNQNQFFCKIPLELWTR

SEQ ID NO: 236 - protein, 64 aa, Artificial sequence
  Mutated sequence
AIEKVTGALKINNLRLVTLEHQVLVIGLKVEAIEKFFYTAFAMQELGCNQNQFFCKIPLELWTR

SEQ ID NO: 237 - protein, 64 aa, Artificial sequence
  Mutated sequence
AIEKVTGALKINNLRLVTLEHQVLVIGLKVEAMEKFFYTAFAMQELGCNQNQFFCKIPLELWTR

SEQ ID NO: 238 - protein, 64 aa, Artificial sequence
  Mutated sequence
AIEKVTGALKINNLRLVTLEHQVLVIGLKVEATEKFFYTAFAMQELGCNQNQFFCKIPLELWTR

SEQ ID NO: 239 - protein, 64 aa, Artificial sequence
  Mutated sequence
AIEKVTGALKINNLRLVTLEHQVLVIGLKVEALEKFFYTAFAMQELGCNQNQFFCKIPLELWTR

SEQ ID NO: 240 - protein, 64 aa, Artificial sequence
  Mutated sequence
AIEKVTGALKINNLRLVTLEHQVLVIGLKVEAIEKPFYTAFAMQELGCNQNQFFCKIPLELWTR

SEQ ID NO: 241 - protein, 64 aa, Artificial sequence
  Mutated sequence
AIEKVTGALKINNLRLVTLEHQVLVIGLKVEAMEKPFYTAFAMQELGCNQNQFFCKIPLELWTR

SEQ ID NO: 242 - protein, 64 aa, Artificial sequence
  Mutated sequence
AIEKVTGALKINNLRLVTLEHQVLVIGLKVEATEKPFYTAFAMQELGCNQNQFFCKIPLELWTR

SEQ ID NO: 243 - protein, 64 aa, Artificial sequence
  Mutated sequence
AIEKVTGALKINNLRLVTLEHQVLVIGLKVEALEKPFYTAFAMQELGCNQNQFFCKIPLELWTR

SEQ ID NO: 244 - protein, 64 aa, Artificial sequence
  Mutated sequence
AIEKVTGALKINNLRLVTLEHQVLVIGLKVEAIEKFAYTAFAMQELGCNQNQFFCKIPLELWTR

SEQ ID NO: 245 - protein, 64 aa, Artificial sequence
  Mutated sequence
AIEKVTGALKINNLRLVTLEHQVLVIGLKVEAMEKFAYTAFAMQELGCNQNQFFCKIPLELWTR

SEQ ID NO: 246 - protein, 64 aa, Artificial sequence
  Mutated sequence
AIEKVTGALKINNLRLVTLEHQVLVIGLKVEATEKFAYTAFAMQELGCNQNQFFCKIPLELWTR

SEQ ID NO: 247 - protein, 64 aa, Artificial sequence
  Mutated sequence
AIEKVTGALKINNLRLVTLEHQVLVIGLKVEALEKFAYTAFAMQELGCNQNQFFCKIPLELWTR

SEQ ID NO: 248 - protein, 64 aa, Artificial sequence
  Mutated sequence
AIEKVTGALKINNLRLVTLEHQVLVIGLKVEAIEKPAYTAFAMQELGCNQNQFFCKIPLELWTR

SEQ ID NO: 249 - protein, 64 aa, Artificial sequence
  Mutated sequence
AIEKVTGALKINNLRLVTLEHQVLVIGLKVEAMEKPAYTAFAMQELGCNQNQFFCKIPLELWTR

SEQ ID NO: 250 - protein, 64 aa, Artificial sequence
  Mutated sequence
AIEKVTGALKINNLRLVTLEHQVLVIGLKVEATEKPAYTAFAMQELGCNQNQFFCKIPLELWTR

SEQ ID NO: 251 - protein, 64 aa, Artificial sequence
  Mutated sequence
AIEKVTGALKINNLRLVTLEHQVLVIGLKVEALEKPAYTAFAMQELGCNQNQFFCKIPLELWTR

SEQ ID NO: 252 - protein, 64 aa, Artificial sequence
  Mutated sequence
AIEKVTGALKINNLRLVTLEHQVLVIGLKVEAIEKRRYTAFAMQELGCNQNQFFCKIPLELWTR

SEQ ID NO: 253 - protein, 64 aa, Artificial sequence
  Mutated sequence
AIEKVTGALKINNLRLVTLEHQVLVIGLKVEAMEKRRYTAFAMQELGCNQNQFFCKIPLELWTR

SEQ ID NO: 254 - protein, 64 aa, Artificial sequence
  Mutated sequence
AIEKVTGALKINNLRLVTLEHQVLVIGLKVEATEKRRYTAFAMQELGCNQNQFFCKIPLELWTR

SEQ ID NO: 255 - protein, 64 aa, Artificial sequence
  Mutated sequence
AIEKVTGALKINNLRLVTLEHQVLVIGLKVEALEKRRYTAFAMQELGCNQNQFFCKIPLELWTR

SEQ ID NO: 256 - protein, 64 aa, Artificial sequence
  Mutated sequence
AIEKVTGALKINNLRLVTLEHQVLVIGLKVEAIEKRAYTAFAMQELGCNQNQFFCKIPLELWTR

SEQ ID NO: 257 - protein, 64 aa, Artificial sequence
  Mutated sequence
AIEKVTGALKINNLRLVTLEHQVLVIGLKVEAMEKRAYTAFAMQELGCNQNQFFCKIPLELWTR

SEQ ID NO: 258 - protein, 64 aa, Artificial sequence
  Mutated sequence
AIEKVTGALKINNLRLVTLEHQVLVIGLKVEATEKRAYTAFAMQELGCNQNQFFCKIPLELWTR

SEQ ID NO: 259 - protein, 64 aa, Artificial sequence
  Mutated sequence
AIEKVTGALKINNLRLVTLEHQVLVIGLKVEALEKRAYTAFAMQELGCNQNQFFCKIPLELWTR

SEQ ID NO: 260 - protein, 64 aa, Artificial sequence
  Mutated sequence
AIEKVTGALKINNLRLVTLEHQVLVIGLKVEAIEKRFYTAFAMQELGCNQNQFFCKIPLELWTR

SEQ ID NO: 261 - protein, 64 aa, Artificial sequence
  Mutated sequence
AIEKVTGALKINNLRLVTLEHQVLVIGLKVEAMEKRFYTAFAMQELGCNQNQFFCKIPLELWTR

SEQ ID NO: 262 - protein, 64 aa, Artificial sequence
  Mutated sequence
AIEKVTGALKINNLRLVTLEHQVLVIGLKVEATEKRFYTAFAMQELGCNQNQFFCKIPLELWTR

SEQ ID NO: 263 - protein, 64 aa, Artificial sequence
  Mutated sequence
AIEKVTGALKINNLRLVTLEHQVLVIGLKVEALEKRFYTAFAMQELGCNQNQFFCKIPLELWTR

SEQ ID NO: 264 - protein, 64 aa, Artificial sequence
  Mutated sequence
AIEKVTGALKINNLRLVTLEHQVLVIGLKVEAIEKRGYTAFAMQELGCNQNQFFCKIPLELWTR

SEQ ID NO: 265 - protein, 64 aa, Artificial sequence
  Mutated sequence
AIEKVTGALKINNLRLVTLEHQVLVIGLKVEAMEKRGYTAFAMQELGCNQNQFFCKIPLELWTR

SEQ ID NO: 266 - protein, 64 aa, Artificial sequence
  Mutated sequence
AIEKVTGALKINNLRLVTLEHQVLVIGLKVEATEKRGYTAFAMQELGCNQNQFFCKIPLELWTR

SEQ ID NO: 267 - protein, 64 aa, Artificial sequence
  Mutated sequence
AIEKVTGALKINNLRLVTLEHQVLVIGLKVEALEKRGYTAFAMQELGCNQNQFFCKIPLELWTR

SEQ ID NO: 268 - protein, 64 aa, Artificial sequence
  Mutated sequence
AIEKVTGALKINNLRLVTLEHQVLVIGLKVEAIEKARYTAFAMQELGCNQNQFFCKIPLELWTR

SEQ ID NO: 269 - protein, 64 aa, Artificial sequence
  Mutated sequence
AIEKVTGALKINNLRLVTLEHQVLVIGLKVEAMEKARYTAFAMQELGCNQNQFFCKIPLELWTR

SEQ ID NO: 270 - protein, 64 aa, Artificial sequence
  Mutated sequence
AIEKVTGALKINNLRLVTLEHQVLVIGLKVEATEKARYTAFAMQELGCNQNQFFCKIPLELWTR

SEQ ID NO: 271 - protein, 64 aa, Artificial sequence
  Mutated sequence
AIEKVTGALKINNLRLVTLEHQVLVIGLKVEALEKARYTAFAMQELGCNQNQFFCKIPLELWTR

SEQ ID NO: 272 - protein, 64 aa, Artificial sequence
  Mutated sequence
AIEKVTGALKINNLRLVTLEHQVLVIGLKVEAIEKAAYTAFAMQELGCNQNQFFCKIPLELWTR

SEQ ID NO: 273 - protein, 64 aa, Artificial sequence
  Mutated sequence
AIEKVTGALKINNLRLVTLEHQVLVIGLKVEAMEKAAYTAFAMQELGCNQNQFFCKIPLELWTR

SEQ ID NO: 274 - protein, 64 aa, Artificial sequence
  Mutated sequence
AIEKVTGALKINNLRLVTLEHQVLVIGLKVEATEKAAYTAFAMQELGCNQNQFFCKIPLELWTR

SEQ ID NO: 275 - protein, 64 aa, Artificial sequence
  Mutated sequence
AIEKVTGALKINNLRLVTLEHQVLVIGLKVEALEKAAYTAFAMQELGCNQNQFFCKIPLELWTR

SEQ ID NO: 276 - protein, 64 aa, Artificial sequence
  Mutated sequence
AIEKVTGALKINNLRLVTLEHQVLVIGLKVEAIEKAFYTAFAMQELGCNQNQFFCKIPLELWTR

SEQ ID NO: 277 - protein, 64 aa, Artificial sequence
  Mutated sequence
AIEKVTGALKINNLRLVTLEHQVLVIGLKVEAMEKAFYTAFAMQELGCNQNQFFCKIPLELWTR

SEQ ID NO: 278 - protein, 64 aa, Artificial sequence
  Mutated sequence
AIEKVTGALKINNLRLVTLEHQVLVIGLKVEATEKAFYTAFAMQELGCNQNQFFCKIPLELWTR

SEQ ID NO: 279 - protein, 64 aa, Artificial sequence
  Mutated sequence
AIEKVTGALKINNLRLVTLEHQVLVIGLKVEALEKAFYTAFAMQELGCNQNQFFCKIPLELWTR

SEQ ID NO: 280 - protein, 64 aa, Artificial sequence
  Mutated sequence
AIEKVTGALKINNLRLVTLEHQVLVIGLKVEAIEKAGYTAFAMQELGCNQNQFFCKIPLELWTR

SEQ ID NO: 281 - protein, 64 aa, Artificial sequence
  Mutated sequence
AIEKVTGALKINNLRLVTLEHQVLVIGLKVEAMEKAGYTAFAMQELGCNQNQFFCKIPLELWTR

SEQ ID NO: 282 - protein, 64 aa, Artificial sequence
  Mutated sequence
AIEKVTGALKINNLRLVTLEHQVLVIGLKVEATEKAGYTAFAMQELGCNQNQFFCKIPLELWTR

SEQ ID NO: 283 - protein, 64 aa, Artificial sequence
  Mutated sequence
AIEKVTGALKINNLRLVTLEHQVLVIGLKVEALEKAGYTAFAMQELGCNQNQFFCKIPLELWTR

SEQ ID NO: 284 - protein, 64 aa, Artificial sequence
  Mutated sequence
AIEKVTGALKINNLRLVTLEHQVLVIGLKVEAIEKGRYTAFAMQELGCNQNQFFCKIPLELWTR

SEQ ID NO: 285 - protein, 64 aa, Artificial sequence
  Mutated sequence
AIEKVTGALKINNLRLVTLEHQVLVIGLKVEAMEKGRYTAFAMQELGCNQNQFFCKIPLELWTR

SEQ ID NO: 286 - protein, 64 aa, Artificial sequence
  Mutated sequence
AIEKVTGALKINNLRLVTLEHQVLVIGLKVEATEKGRYTAFAMQELGCNQNQFFCKIPLELWTR

SEQ ID NO: 287 - protein, 64 aa, Artificial sequence
  Mutated sequence
AIEKVTGALKINNLRLVTLEHQVLVIGLKVEALEKGRYTAFAMQELGCNQNQFFCKIPLELWTR

SEQ ID NO: 288 - protein, 64 aa, Artificial sequence
  Mutated sequence
AIEKVTGALKINNLRLVTLEHQVLVIGLKVEAIEKGAYTAFAMQELGCNQNQFFCKIPLELWTR

SEQ ID NO: 289 - protein, 64 aa, Artificial sequence
  Mutated sequence
AIEKVTGALKINNLRLVTLEHQVLVIGLKVEAMEKGAYTAFAMQELGCNQNQFFCKIPLELWTR

SEQ ID NO: 290 - protein, 64 aa, Artificial sequence
  Mutated sequence
AIEKVTGALKINNLRLVTLEHQVLVIGLKVEATEKGAYTAFAMQELGCNQNQFFCKIPLELWTR

SEQ ID NO: 291 - protein, 64 aa, Artificial sequence
  Mutated sequence
AIEKVTGALKINNLRLVTLEHQVLVIGLKVEALEKGAYTAFAMQELGCNQNQFFCKIPLELWTR

SEQ ID NO: 292 - protein, 64 aa, Artificial sequence
  Mutated sequence
AIEKVTGALKINNLRLVTLEHQVLVIGLKVEAIEKGFYTAFAMQELGCNQNQFFCKIPLELWTR

SEQ ID NO: 293 - protein, 64 aa, Artificial sequence
  Mutated sequence
AIEKVTGALKINNLRLVTLEHQVLVIGLKVEAMEKGFYTAFAMQELGCNQNQFFCKIPLELWTR

SEQ ID NO: 294 - protein, 64 aa, Artificial sequence
  Mutated sequence
AIEKVTGALKINNLRLVTLEHQVLVIGLKVEATEKGFYTAFAMQELGCNQNQFFCKIPLELWTR

SEQ ID NO: 295 - protein, 64 aa, Artificial sequence
  Mutated sequence
AIEKVTGALKINNLRLVTLEHQVLVIGLKVEALEKGFYTAFAMQELGCNQNQFFCKIPLELWTR

SEQ ID NO: 296 - protein, 64 aa, Artificial sequence
  Mutated sequence
AIEKVTGALKINNLRLVTLEHQVLVIGLKVEAIEKGGYTAFAMQELGCNQNQFFCKIPLELWTR

SEQ ID NO: 297 - protein, 64 aa, Artificial sequence
  Mutated sequence
AIEKVTGALKINNLRLVTLEHQVLVIGLKVEAMEKGGYTAFAMQELGCNQNQFFCKIPLELWTR

SEQ ID NO: 298 - protein, 64 aa, Artificial sequence
  Mutated sequence
AIEKVTGALKINNLRLVTLEHQVLVIGLKVEATEKGGYTAFAMQELGCNQNQFFCKIPLELWTR

SEQ ID NO: 299 - protein, 64 aa, Artificial sequence
  Mutated sequence
AIEKVTGALKINNLRLVTLEHQVLVIGLKVEALEKGGYTAFAMQELGCNQNQFFCKIPLELWTR

SEQ ID NO: 300 - protein, 64 aa, Artificial sequence; identical to SEQ ID NO: 220
  Mutated sequence

SEQ ID NO: 301 - protein, 64 aa, Artificial sequence; identical to SEQ ID NO: 221
  Mutated sequence

SEQ ID NO: 302 - protein, 64 aa, Artificial sequence; identical to SEQ ID NO: 222
  Mutated sequence

SEQ ID NO: 303 - protein, 64 aa, Artificial sequence; identical to SEQ ID NO: 223
  Mutated sequence

SEQ ID NO: 304 - protein, 64 aa, Artificial sequence; identical to SEQ ID NO: 244
  Mutated sequence

SEQ ID NO: 305 - protein, 64 aa, Artificial sequence; identical to SEQ ID NO: 245
  Mutated sequence

SEQ ID NO: 306 - protein, 64 aa, Artificial sequence; identical to SEQ ID NO: 246
  Mutated sequence

SEQ ID NO: 307 - protein, 64 aa, Artificial sequence; identical to SEQ ID NO: 247
  Mutated sequence

SEQ ID NO: 308 - protein, 64 aa, Artificial sequence; identical to SEQ ID NO: 236
  Mutated sequence

SEQ ID NO: 309 - protein, 64 aa, Artificial sequence; identical to SEQ ID NO: 237
  Mutated sequence

SEQ ID NO: 310 - protein, 64 aa, Artificial sequence; identical to SEQ ID NO: 238
  Mutated sequence

SEQ ID NO: 311 - protein, 64 aa, Artificial sequence; identical to SEQ ID NO: 239
  Mutated sequence

SEQ ID NO: 312 - protein, 64 aa, Artificial sequence; identical to SEQ ID NO: 228
  Mutated sequence

SEQ ID NO: 313 - protein, 64 aa, Artificial sequence; identical to SEQ ID NO: 229
  Mutated sequence

SEQ ID NO: 314 - protein, 64 aa, Artificial sequence; identical to SEQ ID NO: 230
  Mutated sequence

SEQ ID NO: 315 - protein, 64 aa, Artificial sequence; identical to SEQ ID NO: 231
  Mutated sequence

SEQ ID NO: 316 - protein, 16 aa, Artificial sequence
  Mutated sequence
  misc_feature (1)..(5): Xaa is any naturally occurring amino acid or is mutated
  misc_feature (6)..(6): Xaa is Val or Ile
  misc_feature (7)..(7): Xaa is Glu or Arg
  misc_feature (9)..(9): Xaa is Ile or Met or Thr or Ile
  misc_feature (10)..(14): Xaa is any naturally occurring amino acid or is mutated
XXXXXXXAXXXXXXTA

SEQ ID NO: 317 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKGLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 318 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKLLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 319 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKALYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 320 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFRYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 321 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFGYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 322 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFAYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 323 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFFYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 324 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMRKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 325 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMGKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 326 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMLKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 327 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMAKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 328 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMFKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 329 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMERFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 330 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEGFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 331 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMELFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 332 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEAFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 333 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEFFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 334 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLRTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 335 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLGTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 336 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLLTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 337 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLATAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 338 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLFTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 339 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKRRYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 340 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKRGYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 341 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKRAYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 342 - protein, 855 aa, Artificial sequence
  Mutated sequence
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKRFYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEE

SEQ ID NO: 343 - protein, 9 aa, FIV
  MISC_FEATURE (2)..(2): Xaa is Ile or Met or Thr or Leu
AXEKFLYTA

SEQ ID NO: 344 - protein, 9 aa, FIV
  MISC_FEATURE (2)..(2): Xaa is Ile or Met or Thr or leu
  MISC_FEATURE (3)..(3): Xaa is Ser or Thr or Asn or Gln or Glu or Asp or Lys or His or Met or Cys or Trp or Tyr or Val or Ile or Pro
  MISC_FEATURE (4)..(4): Xaa is Ser or Thr or Asn or Gln or Glu or Asp or Lys or His or Met or Cys or Trp or Tyr or Val or Ile or Pro
  MISC_FEATURE (5)..(5): Xaa is Ser or Thr or Asn or Gln or Glu or Asp or Lys or His or Met or Cys or Trp or Tyr or Val or Ile or Pro or Phe
  MISC_FEATURE (6)..(6): Xaa is Ser or Thr or Asn or Gln or Glu or Asp or Lys or His or Met or Cys or Trp or Tyr or Val or Ile or Pro or Leu
  MISC_FEATURE (7)..(7): Xaa is Ser or Thr or Asn or Gln or Glu or Asp or Lys or His or Met or Cys or Trp or Tyr or Val or Ile or Pro
AXXXXXXTA

SEQ ID NO: 345 - protein, 14 aa, FIV
  MISC_FEATURE (1)..(1): Xaa is Val or Ile
  MISC_FEATURE (2)..(2): Xaa is Glu or Arg
  MISC_FEATURE (4)..(4): Xaa is Ile or Met or Thr or Leu
  MISC_FEATURE (5)..(5): Xaa is Ser or Thr or Asn or Gln or Glu or Asp or Lys or His or Met or Cys or Trp or Tyr or Val or Ile or Pro
  MISC_FEATURE (6)..(6): Xaa is Ser or Thr or Asn or Gln or Glu or Asp or Lys or His or Met or Cys or Trp or Tyr or Val or Ile or Pro
  MISC_FEATURE (7)..(7): Xaa is Ser or Thr or Asn or Gln or Glu or Asp or Lys or His or Met or Cys or Trp or Tyr or Val or Ile or Pro or Phe
  MISC_FEATURE (8)..(8): Xaa is Ser or Thr or Asn or Gln or Glu or Asp or Lys or His or Met or Cys or Trp or Tyr or Val or Ile or Pro or Leu
  MISC_FEATURE (9)..(9): Xaa is Ser or Thr or Asn or Gln or Glu or Asp or Lys or His or Met or Cys or Trp or Tyr or Val or Ile or Pro
  MISC_FEATURE (12)..(12): Xaa is Phe or Leu
XXAXXXXXXTAXAM

SEQ ID NO: 346 - protein, 9 aa, FIV
  MISC_FEATURE (2)..(2): Xaa is Ile or Met or Thr or Val
  MISC_FEATURE (5)..(5): Xaa is Phe or Pro
  MISC_FEATURE (6)..(6): Xaa is Leu or Val or Ile
AXEKXXYTA

SEQ ID NO: 347 - protein, 14 aa, FIV
  MISC_FEATURE (1)..(1): Xaa is Val or Ile
  MISC_FEATURE (2)..(2): Xaa is Glu or Arg
  MISC_FEATURE (4)..(4): Xaa is Ile or Met or Thr or Leu
  MISC_FEATURE (7)..(7): Xaa is Phe or Pro
  MISC_FEATURE (8)..(8): Xaa is Leu or Val or Ile
  MISC_FEATURE (12)..(12): Xaa is Phe or Leu
XXAXEKXXYTAXAM

SEQ ID NO: 348 - DNA, 51 bp, Artificial sequence
  oligonucleotide for introducing mutation within the ISU of lentiviral protein
atacatctcgagaccggtccaactagaaccatggcagaaggatttgcagcc

SEQ ID NO: 349 - DNA, 41 bp, Artificial sequence
  oligonucleotide for introducing mutation within the ISU of lentiviral protein
atacatacgcgttcattcctcctctttttcagacatgccac

SEQ ID NO: 350 - DNA, 35 bp, Artificial sequence
  oligonucleotide for introducing mutation within the ISU of lentiviral protein
tactgctatagggatggtaacacaataccaccaag

SEQ ID NO: 351 - DNA, 40 bp, Artificial sequence
  oligonucleotide for introducing mutation within the ISU of lentiviral protein
gattaaaagtagaagctatggcaaaatttttgtatacagc

SEQ ID NO: 352 - DNA, 40 bp, Artificial sequence
  oligonucleotide for introducing mutation within the ISU of lentiviral protein
gctgtatacaaaaattttgccatagcttctacttttaatc

SEQ ID NO: 353 - DNA, 40 bp, Artificial sequence
  oligonucleotide for introducing mutation within the ISU of lentiviral protein
gattaaaagtagaagctatgagaaaatttttgtatacagc

SEQ ID NO: 354 - DNA, 40 bp, Artificial sequence
  oligonucleotide for introducing mutation within the ISU of lentiviral protein
gctgtatacaaaaattttctcatagcttctacttttaatc

SEQ ID NO: 355 - DNA, 36 bp, Artificial sequence
  oligonucleotide for introducing mutation within the ISU of lentiviral protein
gtagaagctatggaagcatttttgtatacagctttc

SEQ ID NO: 356 - DNA, 36 bp, Artificial sequence
  oligonucleotide for introducing mutation within the ISU of lentiviral protein
gaaagctgtatacaaaaatgcttccatagcttctac

SEQ ID NO: 357 - DNA, 36 bp, Artificial sequence
  oligonucleotide for introducing mutation within the ISU of lentiviral protein
gtagaagctatggaaagatttttgtatacagctttc

SEQ ID NO: 358 - DNA, 36 bp, Artificial sequence
  oligonucleotide for introducing mutation within the ISU of lentiviral protein
gaaagctgtatacaaaaatctttccatagcttctac

SEQ ID NO: 359 - DNA, 33 bp, Artificial sequence
  oligonucleotide for introducing mutation within the ISU of lentiviral protein
gaagctatggaaaaagccttgtatacagctttc

SEQ ID NO: 360 - DNA, 33 bp, Artificial sequence
  oligonucleotide for introducing mutation within the ISU of lentiviral protein
gaaagctgtatacaaggctttttccatagcttc

SEQ ID NO: 361 - DNA, 33 bp, Artificial sequence
  Mutated sequence
gaagctatggaaaaaagattgtatacagctttc

SEQ ID NO: 362 - DNA, 33 bp, Artificial sequence
  oligonucleotide for introducing mutation within the ISU of lentiviral protein
gaaagctgtatacaatcttttttccatagcttc

SEQ ID NO: 363 - DNA, 36 bp, Artificial sequence
  oligonucleotide for introducing mutation within the ISU of lentiviral protein
gctatggaaaaatttgcctatacagctttcgctatg

SEQ ID NO: 364 - DNA, 36 bp, Artificial sequence
  oligonucleotide for introducing mutation within the ISU of lentiviral protein
catagcgaaagctgtataggcaaatttttccatagc

SEQ ID NO: 365 - DNA, 36 bp, Artificial sequence
  oligonucleotide for introducing mutation within the ISU of lentiviral protein
gctatggaaaaatttaggtatacagctttcgctatg

SEQ ID NO: 366 - DNA, 36 bp, Artificial sequence
  oligonucleotide for introducing mutation within the ISU of lentiviral protein
catagcgaaagctgtatacctaaatttttccatagc

SEQ ID NO: 367 - DNA, 36 bp, Artificial sequence
  oligonucleotide for introducing mutation within the ISU of lentiviral protein
ctatggaaaaatttttggccacagctttcgctatgc

SEQ ID NO: 368 - DNA, 36 bp, Artificial sequence
  oligonucleotide for introducing mutation within the ISU of lentiviral protein
gcatagcgaaagctgtggccaaaaatttttccatag

SEQ ID NO: 369 - DNA, 36 bp, Artificial sequence
  oligonucleotide for introducing mutation within the ISU of lentiviral protein
ctatggaaaaatttttgcggacagctttcgctatgc

SEQ ID NO: 370 - DNA, 36 bp, Artificial sequence
  oligonucleotide for introducing mutation within the ISU of lentiviral protein
gcatagcgaaagctgtccgcaaaaatttttccatag

SEQ ID NO: 371 - DNA, 45 bp, Artificial sequence
  oligonucleotide for introducing mutation within the ISU of lentiviral protein
ggtgacgcggcccagccggccgctatagaaaaggtgactggagcc

SEQ ID NO: 372 - DNA, 36 bp, Artificial sequence
  oligonucleotide for introducing mutation within the ISU of lentiviral protein
atacatacgcgtttaccttgtccacaactcaagagg

SEQ ID NO: 373 - DNA, 42 bp, Artificial sequence
  oligonucleotide for introducing mutation within the ISU of lentiviral protein
atacatacgcgtttaccctgttttcccttgtacattattttg

SEQ ID NO: 374 - protein, 856 aa, Artificial sequence
  Mutated sequence
MAEGFAANRQWIGLEEAEELLDFDIATQMSEEGPLNPGVNPFRVPGITEKEKQNYCNILQPKLQDLRNEIQEVKLEEGNAGKFRRARFLRYSDESVLSLVHAFIGYCIYLGNRNKLGSLRHDIDIEAPQEECYNNREKGTTDNIKYGRRCCLGTVTLYLILFIGIIIYSQTTNAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFESKKVKISLQCNSTKNLTFAMRSSGDYGEVTGAWIEFGCHRNKSKLHAEARFRIRCRWNVGSNTSLIDTCGNTQKVSGANPVDCTMYSNKMYNCSLQNGFTMKVDDLIMHFNMKKAVEMYNIAGNWSCTSDLPSSWGYMNCNCTNSSSSYSGTKMACPSNRGILRNWYNPVAGLRQSLEQYQVVKQPDYLVVPEEVMEYKPRRKRAAIHVMLALAAVLSIAGAGTGATAIGMVTQYHQVLATHQEAVEKVTEALKINNLRLVTLEHQVLVIGLKVEAMEKRLYTAFAMQELGCNQNQFFCKIPPELWTRYNMTINQTIWNHGNITLGEWYNQTKDLQQKFYEIIMDIEQNNVQGKKGIQQLQKWEDWVGWIGNIPQYLKGLLGGILGIGLGVLLLILCLPTLVDCIRNCIHKILGYTVIAMPEVEGEEIQPQMELRRNGRQCGMSEKEEE

SEQ ID NO: 375 - protein, 856 aa, Artificial sequence
  Mutated sequence
MAEGFAANRQWIGLEEAEELLDFDIATQMSEEGPLNPGVNPFRVPGITEKEKQNYCNILQPKLQDLRNEIQEVKLEEGNAGKFRRARFLRYSDESVLSLVHAFIGYCIYLGNRNKLGSLRHDIDIEAPQEECYNNREKGTTDNIKYGRRCCLGTVTLYLILFIGIIIYSQTTNAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFESKKVKISLQCNSTKNLTFAMRSSGDYGEVTGAWIEFGCHRNKSKLHAEARFRIRCRWNVGSNTSLIDTCGNTQKVSGANPVDCTMYSNKMYNCSLQNGFTMKVDDLIMHFNMKKAVEMYNIAGNWSCTSDLPSSWGYMNCNCTNSSSSYSGTKMACPSNRGILRNWYNPVAGLRQSLEQYQVVKQPDYLVVPEEVMEYKPRRKRAAIHVMLALAAVLSIAGAGTGATAIGMVTQYHQVLATHQEAVEKVTEALKINNLRLVTLEHQVLVIGLKVEAMEKFRYTAFAMQELGCNQNQFFCKIPPELWTRYNMTINQTIWNHGNITLGEWYNQTKDLQQKFYEIIMDIEQNNVQGKKGIQQLQKWEDWVGWIGNIPQYLKGLLGGILGIGLGVLLLILCLPTLVDCIRNCIHKILGYTVIAMPEVEGEEIQPQMELRRNGRQCGMSEKEEE

SEQ ID NO: 376 - protein, 856 aa, Artificial sequence
  Mutated sequence
MAEGFVANGQWIGPEEAEELVDFEIATQMNEEGPLNPGINPFRVPGITKQEKQEYCSTMQPKLQALRNEIQEVKLEEGNAGKFRRARFLRYSDETILSLIYLFIGYFRYLVDRKRFGSLRHDIDIEAPQEECYNNKEKGMTENIKYGKRCLVGTAALYLILAIGIIIIIRTTDAQVVWRLPPLVVPVEESEIIFWDCWAPEEPACQDFLGAMIHLKASTNISNTEGPTLGNWAREIWATLFKKATRQCRRGRIWKRWNETITGPIGCANNTCYNISVIVPDYQCYIDRVDTWLQGKVNISLCLTGGKMLYNKETKQLSYCTDPLQIPLINYTFGPNQTCMWNISQIQDPEIPKCGWWNQQAYYNNCKWERTDVKFQCQRTQSQPGSWIRAISSWKQGNRWEWRPDFESERVKVSLQCNSTRNLTFAMRSSGDYGEITGAWIEFGCHRNKSIRHNAARFRIRCRWNEGDNNSLIDTCGETQNVSGANPVDCTMYANKMYNCSLQDGFTMKVDDLIMHFNMTKAVEMYNIAGNWSCMSDLPTEWGYMNCNCTNDTSNNNTRKMKCPKENGILRNWYNPVAGLRQSLEKYQVVKQPDYLLVPEEVMEYKPRRKRAAIHVMLALATVLSMAGAGTGATAIGMVTQYHQVLATQQEAIEKVTEALKITNLRLVTLEHQVLVIGLKVEAMEKRLYTAFAMQELGCNQNQFFCKVPPELWRRYNMTINQTIWNHGNITLGEWYNQTKDLQKKFYGIIMDIEQNNVQGKKGLQQLQKWEDWVGWIGNIPQYLKGLLGSIVGIGLGILLLILCLPTLVDCIRNCIHKILGYTVIAMPEVDGEEIQPQMELRRNGRQCGMSEKEEE

SEQ ID NO: 377 - protein, 856 aa, Artificial sequence
  Mutated sequence
MAEGFVANGQWIGPEEAEELVDFEIATQMNEEGPLNPGINPFRVPGITKQEKQEYCSTMQPKLQALRNEIQEVKLEEGNAGKFRRARFLRYSDETILSLIYLFIGYFRYLVDRKRFGSLRHDIDIEAPQEECYNNKEKGMTENIKYGKRCLVGTAALYLILAIGIIIIIRTTDAQVVWRLPPLVVPVEESEIIFWDCWAPEEPACQDFLGAMIHLKASTNISNTEGPTLGNWAREIWATLFKKATRQCRRGRIWKRWNETITGPIGCANNTCYNISVIVPDYQCYIDRVDTWLQGKVNISLCLTGGKMLYNKETKQLSYCTDPLQIPLINYTFGPNQTCMWNISQIQDPEIPKCGWWNQQAYYNNCKWERTDVKFQCQRTQSQPGSWIRAISSWKQGNRWEWRPDFESERVKVSLQCNSTRNLTFAMRSSGDYGEITGAWIEFGCHRNKSIRHNAARFRIRCRWNEGDNNSLIDTCGETQNVSGANPVDCTMYANKMYNCSLQDGFTMKVDDLIMHFNMTKAVEMYNIAGNWSCMSDLPTEWGYMNCNCTNDTSNNNTRKMKCPKENGILRNWYNPVAGLRQSLEKYQVVKQPDYLLVPEEVMEYKPRRKRAAIHVMLALATVLSMAGAGTGATAIGMVTQYHQVLATQQEAIEKVTEALKITNLRLVTLEHQVLVIGLKVEAMEKFRYTAFAMQELGCNQNQFFCKVPPELWRRYNMTINQTIWNHGNITLGEWYNQTKDLQKKFYGIIMDIEQNNVQGKKGLQQLQKWEDWVGWIGNIPQYLKGLLGSIVGIGLGILLLILCLPTLVDCIRNCIHKILGYTVIAMPEVDGEEIQPQMELRRNGRQCGMSEKEEE

SEQ ID NO: 378 - protein, 856 aa, Artificial sequence
  Mutated sequence
MAEGFVANGQWIGPEEAEELLDFDIATQLNEEGPLNPGINPFRVPGITQKEKQEYCNTLQPKLQALRNEIQEVKLEERNAGKFRRARFLRYSDETILSLIYSFVGYFRYLVDRKKFGSLRHDIDIEAPQEEYYNNKEKGMTDNVKYGKRCLVGTAAFYLLLAIGIIIIIRTVDAQVVWRLPPLVVPVEESEIIFWDCWAPEEPACQDFLGAMIHLKASTNIRIQEGPTLGNWAREIWATLFKKATRQCRRGRIWKRWNETITGPIGCANNTCYNISVIIPDYQCYIDRVDTWLQGKVNISICLTGGKMLYNKETKQLSYCTDPLQIPLINYTFGPQQTCMWNTSQIQDPEIPKCGWWNQKAYYNQCSWEQTDVKFQCQRTQSQPGSWIRAISSWRQRNRWEWRPDFESERVKVSLQCNSTQNLTFAMRSSGDYGEITGAWIEFGCHRNKSKHHNEARFRIRCRWNEGNNNSLIDTCGKTQNVLGANPVDCTMYANRMYNCSLQDGFTMKVDDLIMHFNMTKAVEMYNIAGNWSCMSDLPTNWGYMKCNCTNDTSNNHTIKMECPEEKGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAIEKRLYTAFAMQELGCNQNQFFCKVPLELWRRYNMTINQTIWNHGNITLGEWYNQTKALQHKFYEIIMDIEQNNVQGKKGLQQLQKWEDWVGWIGNIPQYLKGLLGGILGIGLGILLLILCLPTLVDCIRNCIHKILGYTVIAMPDVDEEEIQPQMELRRNGRQCGMSEKEEE

SEQ ID NO: 379 - protein, 856 aa, Artificial sequence
  Mutated sequence
MAEGFVANGQWIGPEEAEELLDFDIATQLNEEGPLNPGINPFRVPGITQKEKQEYCNTLQPKLQALRNEIQEVKLEERNAGKFRRARFLRYSDETILSLIYSFVGYFRYLVDRKKFGSLRHDIDIEAPQEEYYNNKEKGMTDNVKYGKRCLVGTAAFYLLLAIGIIIIIRTVDAQVVWRLPPLVVPVEESEIIFWDCWAPEEPACQDFLGAMIHLKASTNIRIQEGPTLGNWAREIWATLFKKATRQCRRGRIWKRWNETITGPIGCANNTCYNISVIIPDYQCYIDRVDTWLQGKVNISICLTGGKMLYNKETKQLSYCTDPLQIPLINYTFGPQQTCMWNTSQIQDPEIPKCGWWNQKAYYNQCSWEQTDVKFQCQRTQSQPGSWIRAISSWRQRNRWEWRPDFESERVKVSLQCNSTQNLTFAMRSSGDYGEITGAWIEFGCHRNKSKHHNEARFRIRCRWNEGNNNSLIDTCGKTQNVLGANPVDCTMYANRMYNCSLQDGFTMKVDDLIMHFNMTKAVEMYNIAGNWSCMSDLPTNWGYMKCNCTNDTSNNHTIKMECPEEKGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAIEKFRYTAFAMQELGCNQNQFFCKVPLELWRRYNMTINQTIWNHGNITLGEWYNQTKALQHKFYEIIMDIEQNNVQGKKGLQQLQKWEDWVGWIGNIPQYLKGLLGGILGIGLGILLLILCLPTLVDCIRNCIHKILGYTVIAMPDVDEEEIQPQMELRRNGRQCGMSEKEEE

SEQ ID NO: 380 - protein, 854 aa, Artificial sequence
  Mutated sequence
MAEGFAANRQWIGPEEAEELLDFDIAIQMNEEGPLNPGVNPFRVPGITEAEKQEYCNILQPKLQDLKGKIQEVKLEEGNAGKFRRARFLRYSDETVLSLIHLFIGYCPHLCRRHELGSLRHDIDIEALQEERYNDREKGITDNIKYGKRCLIGTAVLYLLLSLGIIIHTCKAQVVWRLPPLVVPVEESEIIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKVNISLCLTGGKMLYNKETKQLSYCTDPLQIPLINYTFGPNQTCMWNTSQIQDPEIPKCGWWNQNAYYNSCRWEHTDVQFQCQRTQSQPGSWIRAISSWKQRNRWEWRPDFESEKVKVSLQCNSTKNLTFAMRSSGDYGEVTGAWIEFGCHRTKSKYHTEARFRIRCRWNVGDNTSLIDTCGETQNVSRANPVDCTMYANRMYNCSLQNGFTMKVDDLIMHFNKTKAVEMYNIAGNWSCKSDLPPTWGYMNCNCTNSTNSGTGIRMACPRNQGILRNWYNPVAGLRQSLEKYQVVKQPDYLVVPGEVMEYKPRRKRAAIHVMLALATVLSMAGAGTGATAIGMVTQYQQVLATHQEAIEKVTEALKINNLRLVTLEHQVLVIGLKVEAMEKRLYTAFAMQELGCNQNQFFCKVPSALWERYNMTINQTIWNHGNITLGEWYNQTKDLQQRFYEIIMDIEQNNVQGKKGLQQLQEWEDWVGWIGNIPQYLKGLLGGILGIGLGMLLLILCLPTLVDCIRNCIHKILGYTVIAMPEVEEEEIQPQMELRRNGRQCGMSEKEEE

SEQ ID NO: 381 - protein, 854 aa, Artificial sequence
  Mutated sequence
MAEGFAANRQWIGPEEAEELLDFDIAIQMNEEGPLNPGVNPFRVPGITEAEKQEYCNILQPKLQDLKGKIQEVKLEEGNAGKFRRARFLRYSDETVLSLIHLFIGYCPHLCRRHELGSLRHDIDIEALQEERYNDREKGITDNIKYGKRCLIGTAVLYLLLSLGIIIHTCKAQVVWRLPPLVVPVEESEIIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKVNISLCLTGGKMLYNKETKQLSYCTDPLQIPLINYTFGPNQTCMWNTSQIQDPEIPKCGWWNQNAYYNSCRWEHTDVQFQCQRTQSQPGSWIRAISSWKQRNRWEWRPDFESEKVKVSLQCNSTKNLTFAMRSSGDYGEVTGAWIEFGCHRTKSKYHTEARFRIRCRWNVGDNTSLIDTCGETQNVSRANPVDCTMYANRMYNCSLQNGFTMKVDDLIMHFNKTKAVEMYNIAGNWSCKSDLPPTWGYMNCNCTNSTNSGTGIRMACPRNQGILRNWYNPVAGLRQSLEKYQVVKQPDYLVVPGEVMEYKPRRKRAAIHVMLALATVLSMAGAGTGATAIGMVTQYQQVLATHQEAIEKVTEALKINNLRLVTLEHQVLVIGLKVEAMEKFRYTAFAMQELGCNQNQFFCKVPSALWERYNMTINQTIWNHGNITLGEWYNQTKDLQQRFYEIIMDIEQNNVQGKKGLQQLQEWEDWVGWIGNIPQYLKGLLGGILGIGLGMLLLILCLPTLVDCIRNCIHKILGYTVIAMPEVEEEEIQPQMELRRNGRQCGMSEKEEE

SEQ ID NO: 382 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRDEIQEVKLEEGNAGKFRRTRFLRYSDEHVLSLVHAFIGYCIYLGNRNKLGSLRHDIDIEAPQEEYYNNREKGTTDNIKYGRRCCLGTVTLYLILFIGVIVYSQTAGAQVVWRLPPLVVPVEESEIIFWDCWAPDEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNRCKWEEAKVKFHCQRTQSQPGSWRRAISSWKQRNRWEWRPDLESEKVKISLQCNSKKNLTFAMRSSGDYGEVTGAWIEFGCHRNKSKHHSEARFRIRCRWNVGSNTSLIDTCGNTQDVSGANPVDCTMYSNKMYNCSLQNGFTMKVDDLIVHFSMTKAVKMYNIAGNWSCTSDLPSSWGYMNCNCTNSSSSYSGTKMACPSNRGILRNWYNPVAGLRQSLEQYQVVKQPDYLVVPEEVMEYKPRRKRAAIHVMLALATVLSIAGAGTGATAIGMVTQYHQVLATHQEAIEKVTEALKINNLRLVTLEHQVLVIGLKVEAMEKRLYTAFAMQELGCNQNQFFCKIPPGLWTRYNMTINQTIWNHGNITLGEWYNKTKDLQQKFYEIIMDIEQNNVQGKTGIQQLQKWEDWVGWIGNIPQYLKGLLGGILGIGLGVLLLILCLPTLVDCIRNCIHKILGYTVIAMPEVEGEEIQPQMELRRNGRQCGMSEKEEE

SEQ ID NO: 383 - protein, 856 aa, Artificial sequence
  Mutated sequence
MAEGFAANRQWIGPEEAEELLDFDIATQMSEEGPLNPGVNPFRVPGITEKEKQNYCNILQPKLQDLRDEIQEVKLEEGNAGKFRRTRFLRYSDEHVLSLVHAFIGYCIYLGNRNKLGSLRHDIDIEAPQEEYYNNREKGTTDNIKYGRRCCLGTVTLYLILFIGVIVYSQTAGAQVVWRLPPLVVPVEESEIIFWDCWAPDEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNRCKWEEAKVKFHCQRTQSQPGSWRRAISSWKQRNRWEWRPDLESEKVKISLQCNSKKNLTFAMRSSGDYGEVTGAWIEFGCHRNKSKHHSEARFRIRCRWNVGSNTSLIDTCGNTQDVSGANPVDCTMYSNKMYNCSLQNGFTMKVDDLIVHFSMTKAVKMYNIAGNWSCTSDLPSSWGYMNCNCTNSSSSYSGTKMACPSNRGILRNWYNPVAGLRQSLEQYQVVKQPDYLVVPEEVMEYKPRRKRAAIHVMLALATVLSIAGAGTGATAIGMVTQYHQVLATHQEAIEKVTEALKINNLRLVTLEHQVLVIGLKVEAMEKFRYTAFAMQELGCNQNQFFCKIPPGLWTRYNMTINQTIWNHGNITLGEWYNKTKDLQQKFYEIIMDIEQNNVQGKTGIQQLQKWEDWVGWIGNIPQYLKGLLGGILGIGLGVLLLILCLPTLVDCIRNCIHKILGYTVIAMPEVEGEEIQPQMELRRNGRQCGMSEKEEE

SEQ ID NO: 384 - protein, 855 aa, Artificial sequence
  Mutated sequence
MAKGFAANRQWIGPEEAEELLDFDIATQMNEEGPLNPGVNPFRVPGITEQEKQDYCNILQPKLQELRNEIQEVKLEEGNAGKFRRARFLRYSDETILSLIHLFIGYCTYLCKRNELGSLRHDIDIEAPQEECYNNKEKGTTNNIKYGGRCFIGTMIMYLLIFIGIIIYIQTTEAQVVWRLPPLIVPVKESEIIFWDCWAPEEPACQDFLGAMIHLKASTNISIQEGPTLGNWAREIWGTLFKKATRQCRRGRIWKRWNETITGPLGCANNTCYNISVIVPDYQCYLDRVDTWLQGKVNISLCLTGGKMLYNKDTKQLSYCTDPLQIPLINYTFGPNQTCMWNTSQIQDPEIPKCGWWNQIAYYNSCKWEKTDVKFHCQRTQSQPGSWIRAISSWRQRNRWEWRPDFESEKVKVSLQCNSTKNLTFAMRSSGDYGEVTGAWIEFGCHRKKSKLHTEARFRIRCRWNVGNNASLIDTCGNTPDVSGANPVNCTMYANKMYNCWLQNGFTIKVDDLIMHFNMTKAVEMYNIAGNWSCTSDLPPTWGYMKCNCTNNSDDTRGKMACPRTQGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAMEKRLYTAFAMQELGCNQNQFFCKVPPQLWKRYNMTINQTIWNHGNITLGEWYNQTKDLQQKFYEIIMDIEQNNVQGKTGIQQLQRWEDWVGWIGNIPQYLKGLLGGILGIGLGVLLLILCLPTLVDCIRNCIHKILGYTVIAMPEVEEEEIQQQMELRRNGRQCGMSEKEEE

SEQ ID NO: 385 - protein, 855 aa, Artificial sequence
  Mutated sequence
MAKGFAANRQWIGPEEAEELLDFDIATQMNEEGPLNPGVNPFRVPGITEQEKQDYCNILQPKLQELRNEIQEVKLEEGNAGKFRRARFLRYSDETILSLIHLFIGYCTYLCKRNELGSLRHDIDIEAPQEECYNNKEKGTTNNIKYGGRCFIGTMIMYLLIFIGIIIYIQTTEAQVVWRLPPLIVPVKESEIIFWDCWAPEEPACQDFLGAMIHLKASTNISIQEGPTLGNWAREIWGTLFKKATRQCRRGRIWKRWNETITGPLGCANNTCYNISVIVPDYQCYLDRVDTWLQGKVNISLCLTGGKMLYNKDTKQLSYCTDPLQIPLINYTFGPNQTCMWNTSQIQDPEIPKCGWWNQIAYYNSCKWEKTDVKFHCQRTQSQPGSWIRAISSWRQRNRWEWRPDFESEKVKVSLQCNSTKNLTFAMRSSGDYGEVTGAWIEFGCHRKKSKLHTEARFRIRCRWNVGNNASLIDTCGNTPDVSGANPVNCTMYANKMYNCWLQNGFTIKVDDLIMHFNMTKAVEMYNIAGNWSCTSDLPPTWGYMKCNCTNNSDDTRGKMACPRTQGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAMEKFRYTAFAMQELGCNQNQFFCKVPPQLWKRYNMTINQTIWNHGNITLGEWYNQTKDLQQKFYEIIMDIEQNNVQGKTGIQQLQRWEDWVGWIGNIPQYLKGLLGGILGIGLGVLLLILCLPTLVDCIRNCIHKILGYTVIAMPEVEEEEIQQQMELRRNGRQCGMSEKEEE

SEQ ID NO: 386 - protein, 853 aa, Artificial sequence
  Mutated sequence
MAEGFAANRQWIGPEEAEELLDFDIATQMNEEGPLNPGINPFRVPGITEIEKQAYCKILQPRLQALRNEIQEVKLEEGNAGKFRRARFLRYSDVAILSLIHVFIGYCTYLCNQQKLGSLRHDIDIEAPQEEYYSNNEKGTTDNIKYGRRCVIGTVALYLLICTGIIIYTRTATAQVVWRLPPLVVPVEESEVIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKINISLCLTGGKMLYNRYTKQLSYCTDPLQIPLINYTFGPNQTCMWNTSQIQDPEIPKCGWWNQRAYYNSCRWESTDVKFHCQRTQSQPGSWLRAISSWRQRNRWEWRPDFESEKVKVSLQCNSTKNLTFAMRSSGDYGDVTGAWIEFGCHRNKSRLHTEARFRIRCRWNVGDNTSLIDTCGKTQNIAGANPVDCTMYVNRMYNCSLQNGFTMKVDDLIMHFNMTKAVEMYNIAGNWSCTSNLPPTWGYINCNCTNSSDSNKMACPSSQGILRNWYNPVAGLRQSLEKYQVVKQPDYLVVPGEVMEYKPRRKRAAIHVMLALATILSMAGAGTGATAIGMVTQYHQVLATHQEAIEKVTEALKVNNLRLITLEHQVLVIGLKVEAMEKRLYTAFAMQELGCNQNQFFCKVPPELWKRYNMTINQTIWNHGNITLGEWYNQTKGLQQKFYEIIMDIEQNSVQGKKGIQQLQEWEDWIGWIGNIPQYLKGLLGGILGIGLGVLLLILCLPTLVDCIRNCIHKILGYTVIAMPEVEGEEIQPQMELRRNGRQCGMSEKEEE

SEQ ID NO: 387 - protein, 853 aa, Artificial sequence
  Mutated sequence
MAEGFAANRQWIGPEEAEELLDFDIATQMNEEGPLNPGINPFRVPGITEIEKQAYCKILQPRLQALRNEIQEVKLEEGNAGKFRRARFLRYSDVAILSLIHVFIGYCTYLCNQQKLGSLRHDIDIEAPQEEYYSNNEKGTTDNIKYGRRCVIGTVALYLLICTGIIIYTRTATAQVVWRLPPLVVPVEESEVIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKINISLCLTGGKMLYNRYTKQLSYCTDPLQIPLINYTFGPNQTCMWNTSQIQDPEIPKCGWWNQRAYYNSCRWESTDVKFHCQRTQSQPGSWLRAISSWRQRNRWEWRPDFESEKVKVSLQCNSTKNLTFAMRSSGDYGDVTGAWIEFGCHRNKSRLHTEARFRIRCRWNVGDNTSLIDTCGKTQNIAGANPVDCTMYVNRMYNCSLQNGFTMKVDDLIMHFNMTKAVEMYNIAGNWSCTSNLPPTWGYINCNCTNSSDSNKMACPSSQGILRNWYNPVAGLRQSLEKYQVVKQPDYLVVPGEVMEYKPRRKRAAIHVMLALATILSMAGAGTGATAIGMVTQYHQVLATHQEAIEKVTEALKVNNLRLITLEHQVLVIGLKVEAMEKFRYTAFAMQELGCNQNQFFCKVPPELWKRYNMTINQTIWNHGNITLGEWYNQTKGLQQKFYEIIMDIEQNSVQGKKGIQQLQEWEDWIGWIGNIPQYLKGLLGGILGIGLGVLLLILCLPTLVDCIRNCIHKILGYTVIAMPEVEGEEIQPQMELRRNGRQCGMSEKEEE

SEQ ID NO: 388 - protein, 827 aa, Artificial sequence
  Mutated sequence
MNEEGPLNPGINPFRVPGITETEKQDYCNMLQPKLQALRNEIQEVKLEEGNAGKFRRARFLRYSDETILSLIHLFIGYCTYLLNRKELGSLRHDIDIEAPQEECYSSREQSITDNIKYGKRCFIGTAGLYLLLFIGVGIYLGTAKAQVVWRLPPLVVPVEESEIIFWDCWAPEEPACQDFLGAMIHLKASTNISIQEGPTLGNWAKEIWGTLFKKATRQCRRGRIWKRWNETISGPLGCANNTCYNISVIVPDYQCYLDRVDTWLQGKVNVSLCLTGGKILYNKYTKQLSYCTDPLQIPLISYTFGPNQTCMWDTSQIQDPEIPKCGWWNQIAYYNSCRWESTDVKFHCQRTQSQPGLWLRAISSWKQRNRWEWRPDFESEKAKVSLQCNSTKNLTFAMRSSGDYGEVTGAWIEFGCHRNKSKLHTEARFRIRCRWNVGDNTSLIDTCGETQNVSGANPVDCTMYANRMYNCSLQNGFTMKVDDLIMHFNMTKAVEMYDIAGNWSCTSDLPPTWGYMNCNCTNSSSTNSVKMACPKNQGILRNWYNPVAGLRQSLEKYQVVKQPDYLVVPGEVMEYKPRRKRAAIHVMLALATVLSMAGAGTGATAIGMVTQYHQVLATHQETIEKVTEALKINNLRLVTLEHQVLVIGLKVEAMEKRLYTAFAMQELGCNQNQFFCKVPPELWKRYNMTINQTIWNHGNITLGEWYNQTKELQQKFYEIIMNIEQNNVQVKKGLQQLQEWEDWVGWIGNIPQYLKGLLGGILGIGIGVLLLILCLPTLVDCIRNCISKVLGYTVIAMPEIGDEEETVQMELRKNGRQCGMSEKEEE

SEQ ID NO: 389 - protein, 827 aa, Artificial sequence
  Mutated sequence
MNEEGPLNPGINPFRVPGITETEKQDYCNMLQPKLQALRNEIQEVKLEEGNAGKFRRARFLRYSDETILSLIHLFIGYCTYLLNRKELGSLRHDIDIEAPQEECYSSREQSITDNIKYGKRCFIGTAGLYLLLFIGVGIYLGTAKAQVVWRLPPLVVPVEESEIIFWDCWAPEEPACQDFLGAMIHLKASTNISIQEGPTLGNWAKEIWGTLFKKATRQCRRGRIWKRWNETISGPLGCANNTCYNISVIVPDYQCYLDRVDTWLQGKVNVSLCLTGGKILYNKYTKQLSYCTDPLQIPLISYTFGPNQTCMWDTSQIQDPEIPKCGWWNQIAYYNSCRWESTDVKFHCQRTQSQPGLWLRAISSWKQRNRWEWRPDFESEKAKVSLQCNSTKNLTFAMRSSGDYGEVTGAWIEFGCHRNKSKLHTEARFRIRCRWNVGDNTSLIDTCGETQNVSGANPVDCTMYANRMYNCSLQNGFTMKVDDLIMHFNMTKAVEMYDIAGNWSCTSDLPPTWGYMNCNCTNSSSTNSVKMACPKNQGILRNWYNPVAGLRQSLEKYQVVKQPDYLVVPGEVMEYKPRRKRAAIHVMLALATVLSMAGAGTGATAIGMVTQYHQVLATHQETIEKVTEALKINNLRLVTLEHQVLVIGLKVEAMEKFRYTAFAMQELGCNQNQFFCKVPPELWKRYNMTINQTIWNHGNITLGEWYNQTKELQQKFYEIIMNIEQNNVQVKKGLQQLQEWEDWVGWIGNIPQYLKGLLGGILGIGIGVLLLILCLPTLVDCIRNCISKVLGYTVIAMPEIGDEEETVQMELRKNGRQCGMSEKEEE

SEQ ID NO: 390 - protein, 857 aa, Artificial sequence
  Mutated sequence
MAEGFAANRQWIGPEEAEELLDFDIATQMNEEGPLNPGINPFRVPGITEIEKRDYCKILQPKLQDLKNEIQEVKLEEGNAGKFRRARFLRYSDENILSLIHLFIGYCTYLCRKNELGSLRHDIDIDEHQEEYYTNIEKGTTANIKYGRRCLIGTAALYLLFIGIIIYTQTTKAQVVWRLPPFVVPVEESEIIFWDCWAPEEPACQDFLGAMIHLKASTNISIQEGPTLGNWAREIWGTLFKKATRQCRRGRVWRRWNETITGPSGCANNTCYNISVIVPDYQCYLDRVDTWLQGKVNISLCLTGGKMLYNKYTKQLSYCTDPLQIPLINYTFGPNQTCMWNTSQIQDPEIPKCGWWNQAAYYNSCRWESTDVKFHCQRTQSLPGTWLRTISSWRPKNRWEWRPDFESEKVKVSLQCNSTNNLTFAMRSSGDYGEVTGAWIEFGCHRKKSKLHSEARFRIRCRWDKGDNTSLIDTCGKTQNVLGANPVDCTMYANRMYNCSLQNGFTMKIDDLVMHFNMTKAVEMYNIAGNWSCTSDLPPTWGYMNCNCTNSSSTSSSSGNKMACPGDKGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAMEKRLYTAFAMQELGCNQNQFFCKVPPVLWERYNMTINQTIWNHGNITLGEWYNQTKDLQQKFYEIIMDIEQNNVQGKKGLQQLQKWEDWVGWIGNIPKYLKGLLGGILGIGLGVILLILCLPTLVDCVRNCIHKILGYTVIAMPEVEEEEIQPQMELRRNGRQCGISEKEEE

SEQ ID NO: 391 - protein, 857 aa, Artificial sequence
  Mutated sequence
MAEGFAANRQWIGPEEAEELLDFDIATQMNEEGPLNPGINPFRVPGITEIEKRDYCKILQPKLQDLKNEIQEVKLEEGNAGKFRRARFLRYSDENILSLIHLFIGYCTYLCRKNELGSLRHDIDIDEHQEEYYTNIEKGTTANIKYGRRCLIGTAALYLLFIGIIIYTQTTKAQVVWRLPPFVVPVEESEIIFWDCWAPEEPACQDFLGAMIHLKASTNISIQEGPTLGNWAREIWGTLFKKATRQCRRGRVWRRWNETITGPSGCANNTCYNISVIVPDYQCYLDRVDTWLQGKVNISLCLTGGKMLYNKYTKQLSYCTDPLQIPLINYTFGPNQTCMWNTSQIQDPEIPKCGWWNQAAYYNSCRWESTDVKFHCQRTQSLPGTWLRTISSWRPKNRWEWRPDFESEKVKVSLQCNSTNNLTFAMRSSGDYGEVTGAWIEFGCHRKKSKLHSEARFRIRCRWDKGDNTSLIDTCGKTQNVLGANPVDCTMYANRMYNCSLQNGFTMKIDDLVMHFNMTKAVEMYNIAGNWSCTSDLPPTWGYMNCNCTNSSSTSSSSGNKMACPGDKGILRNWYNPVAGLRQSLEKYQVVKQPDYLVVPGEVMEYKPRRKRAAIHVMLALATVLSMAGAGTGATAIGMVTQYHQVLATHQEAIEKVTEALKINNLRLVTLEHQVLVIGLKVEAMEKFRYTAFAMQELGCNQNQFFCKVPPVLWERYNMTINQTIWNHGNITLGEWYNQTKDLQQKFYEIIMDIEQNNVQGKKGLQQLQKWEDWVGWIGNIPKYLKGLLGGILGIGLGVILLILCLPTLVDCVRNCIHKILGYTVIAMPEVEEEEIQPQMELRRNGRQCGISEKEEE

SEQ ID NO: 392 - protein, 855 aa, Artificial sequence
  Mutated sequence
MAEGFAVNRQWIGPEEAEELLDFDIATQMNEEGPLNPGINLFRVPGITETEKQEYCNILQPKLQDLRNEIQEVKLEEGNAGKFRRARFLRYSDETILSLIHLFIGYCTYLCKRNKLGTLVHNIDIEAPQEECYSNRERGTTVNIKYSRRCCIGTTALYLLLLTGIIIYTQTTQAQVVWRLPPLVVPVEESEIIFWDCWAPEEPACQDFLGAMIYLKASTNISIQEGPTLGNWAREIWGTLFKKATRQCRRGRIWRRWNETITGPSGCANNTCYNISVIVPDYQCYLDRVDTWLQGKVNISLCLTGGKMLYNKDTKQLSYCTDPLQIPLINYTFGPNQTCMWNTSQIQDSDIPKCGWWNQIAYYNSCRWEQTDVKFHCQRTQSQPGTWLRTISSWKQKNRWEWRPDFESEKVRVSLQCNTTKNLTFAMRSSGDYGEVTGAWIEFGCHRNKSKLHSDARFRIRCRWNVGDNTSLIDTCGNDPNVSGANPVDCTMYANRMYNCSLQNGFTMKVDDLIMHFNMTKAVEMYNIAGNWSCTSDLPSTWGYMNCNCTNSSSTDSNKMACPKRQGILRNWYNPVAGLRQSLEKYQVVKQPDYLVVPREVMEYKPRRKRAAIHVMLALATVLSMAGAGTGATAIGMVTQYHQVLATHQETIEKITEALKVNNLRLVTLEHQVLVIGLKVEAIEKRLYTAFAMQELGCNQNQFFCKVPPELWQRYNMTINQTIWNHGNITLGEWYNQTKDLQQKFYEIIMDMEQNNVQGRKGLQQLQEWEDWVGWLGNIPRYLKGLLGGILGIGLGVLLLILCLPTLVDCIRNCISKVLGYTVIAMPEVEEEEIQPPMELRRNGRQCDMSEKEEE

SEQ ID NO: 393 - protein, 855 aa, Artificial sequence
  Mutated sequence
MAEGFAVNRQWIGPEEAEELLDFDIATQMNEEGPLNPGINLFRVPGITETEKQEYCNILQPKLQDLRNEIQEVKLEEGNAGKFRRARFLRYSDETILSLIHLFIGYCTYLCKRNKLGTLVHNIDIEAPQEECYSNRERGTTVNIKYSRRCCIGTTALYLLLLTGIIIYTQTTQAQVVWRLPPLVVPVEESEIIFWDCWAPEEPACQDFLGAMIYLKASTNISIQEGPTLGNWAREIWGTLFKKATRQCRRGRIWRRWNETITGPSGCANNTCYNISVIVPDYQCYLDRVDTWLQGKVNISLCLTGGKMLYNKDTKQLSYCTDPLQIPLINYTFGPNQTCMWNTSQIQDSDIPKCGWWNQIAYYNSCRWEQTDVKFHCQRTQSQPGTWLRTISSWKQKNRWEWRPDFESEKVRVSLQCNTTKNLTFAMRSSGDYGEVTGAWIEFGCHRNKSKLHSDARFRIRCRWNVGDNTSLIDTCGNDPNVSGANPVDCTMYANRMYNCSLQNGFTMKVDDLIMHFNMTKAVEMYNIAGNWSCTSDLPSTWGYMNCNCTNSSSTDSNKMACPKRQGILRNWYNPVAGLRQSLEKYQVVKQPDYLVVPREVMEYKPRRKRAAIHVMLALATVLSMAGAGTGATAIGMVTQYHQVLATHQETIEKITEALKVNNLRLVTLEHQVLVIGLKVEAIEKFRYTAFAMQELGCNQNQFFCKVPPELWQRYNMTINQTIWNHGNITLGEWYNQTKDLQQKFYEIIMDMEQNNVQGRKGLQQLQEWEDWVGWLGNIPRYLKGLLGGILGIGLGVLLLILCLPTLVDCIRNCISKVLGYTVIAMPEVEEEEIQPPMELRRNGRQCDMSEKEEE

SEQ ID NO: 394 - protein, 857 aa, Artificial sequence
  Mutated sequence
MAAGFSQNRQWIGPEEAEELLDFDIATQINEEGPLNPGVNPFRVPGITDTEKQDYCKILQPKLQELREEINEVKLDEDNAGKFRRVRYLRYADETVLSLIYALVGYLRYLGNRNKLGSLRHDIDIEVSAKEQFDKKEKGTTINQKYCTRCCVGISVLYLILFIIIVAVTGSQAQVVWRHPPLVVPVEETEIIFWDCWAPEEPACQDFLGTMVQLKASINIGIQEGPTLGHWAREIWSTLFKKATRQCRRGRVWRRWNETITGPLGCANNTCYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCLRTQSQPGNWLRTISSWKQSNRWIWRPDFESDKVKISLQCNSTKNLTFAMRSSGDYGEITGAWIEFGCYRNKSKSHGEARFRIRCRWNEGTNTSLIDTCGSTPNVKGANPVDCTMKANTMYNCSLQNGFTMKIEDLIVHFNMTKAVEMYNIAGNWSCNSDIPPGWGYMNCNCTNSTSSSFPTCPKMACPRERGILRNWYNPIAGLRHALQKYQVVKQPAYLLVPEEVMEYKPSQKRAAIHIILALATVLSIAGAGTGATAIGMVTQYHQVLATHQKAIDQITEALKINNLRLVTLEHQVLVIGLKVEAIEKRIYTAFAMQELGCNQNQFFCKIPPELWIRYNMSINQTIWNHGNISLRDWYNNTQQLQKKFYEIIYDIEQNNVQGKQGLQQLQKWETWVSWIGKIPQYLKGLFGSILGIGLGILLMILCLPTLVDCMRNCLNRVLGYTVIAMPTIDDEGTDFPVELRRNGGQCGMSEKEEE

SEQ ID NO: 395 - protein, 857 aa, Artificial sequence
  Mutated sequence
MAAGFSQNRQWIGPEEAEELLDFDIATQINEEGPLNPGVNPFRVPGITDTEKQDYCKILQPKLQELREEINEVKLDEDNAGKFRRVRYLRYADETVLSLIYALVGYLRYLGNRNKLGSLRHDIDIEVSAKEQFDKKEKGTTINQKYCTRCCVGISVLYLILFIIIVAVTGSQAQVVWRHPPLVVPVEETEIIFWDCWAPEEPACQDFLGTMVQLKASINIGIQEGPTLGHWAREIWSTLFKKATRQCRRGRVWRRWNETITGPLGCANNTCYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCLRTQSQPGNWLRTISSWKQSNRWIWRPDFESDKVKISLQCNSTKNLTFAMRSSGDYGEITGAWIEFGCYRNKSKSHGEARFRIRCRWNEGTNTSLIDTCGSTPNVKGANPVDCTMKANTMYNCSLQNGFTMKIEDLIVHFNMTKAVEMYNIAGNWSCNSDIPPGWGYMNCNCTNSTSSSFPTCPKMACPRERGILRNWYNPIAGLRHALQKYQVVKQPAYLLVPEEVMEYKPSQKRAAIHIILALATVLSIAGAGTGATAIGMVTQYHQVLATHQKAIDQITEALKINNLRLVTLEHQVLVIGLKVEAIEKFRYTAFAMQELGCNQNQFFCKIPPELWIRYNMSINQTIWNHGNISLRDWYNNTQQLQKKFYEIIYDIEQNNVQGKQGLQQLQKWETWVSWIGKIPQYLKGLFGSILGIGLGILLMILCLPTLVDCMRNCLNRVLGYTVIAMPTIDDEGTDFPVELRRNGGQCGMSEKEEE

SEQ ID NO: 396 - protein, 852 aa, Artificial sequence
  Mutated sequence
MAAGFTQNRQWIGPEEAEELLDFDIVTQINEEGPLNPGVNPFRVPAITDTEKQDYCKILQPKLQELREEIKETKLDESNAGKFRRVRYLRYADETALSLIYALVGYLRYLLERRKLGSLRHDVDIEVSAKEQFNKKEKGTTVNQNYCTKCCVGISVLYFILFLILVAVTRSQAQVVWRLPPLVVPVEETEIIFWDCWAPEEPACQDFLGTMVQLKASINISIQEGPTLGHWAREILETLFKKATRQCRRGRVWKRWNETITGPLGCANNTCYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCQRTQSQPGTWLRAIASWKQANRWIWRPDFESDKVKISLQCNSTKNLTFAMRSSSDYGEITGAWIEFGCYRNKSKFHDEARFRIRCRWNEGTNTSLIDTCGDNPNVTGANPVDCTMRANIMYNCSLQNGFTMKIEDLIVHFNMTKAVEMYNIAGNWSCTSDLPKGWGYMNCNCTNGTDNTKMTCPENQGILRNWYNPVAGLRQALMKYQVVKQPEYLIVPEEVMQYKSKQKRAAIHIMLALATVLSMAGAGTGATAIGMVTQYHQVLATHQQALDKITEALKINNLRLITLEHQVLVIGLKVEAIEKRLYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 397 - protein, 852 aa, Artificial sequence
  Mutated sequence
MAAGFTQNRQWIGPEEAEELLDFDIVTQINEEGPLNPGVNPFRVPAITDTEKQDYCKILQPKLQELREEIKETKLDESNAGKFRRVRYLRYADETALSLIYALVGYLRYLLERRKLGSLRHDVDIEVSAKEQFNKKEKGTTVNQNYCTKCCVGISVLYFILFLILVAVTRSQAQVVWRLPPLVVPVEETEIIFWDCWAPEEPACQDFLGTMVQLKASINISIQEGPTLGHWAREILETLFKKATRQCRRGRVWKRWNETITGPLGCANNTCYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCQRTQSQPGTWLRAIASWKQANRWIWRPDFESDKVKISLQCNSTKNLTFAMRSSSDYGEITGAWIEFGCYRNKSKFHDEARFRIRCRWNEGTNTSLIDTCGDNPNVTGANPVDCTMRANIMYNCSLQNGFTMKIEDLIVHFNMTKAVEMYNIAGNWSCTSDLPKGWGYMNCNCTNGTDNTKMTCPENQGILRNWYNPVAGLRQALMKYQVVKQPEYLIVPEEVMQYKSKQKRAAIHIMLALATVLSMAGAGTGATAIGMVTQYHQVLATHQQALDKITEALKINNLRLITLEHQVLVIGLKVEAIEKFRYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 398 - protein, 853 aa, Artificial sequence
  Mutated sequence
MAEGFCQNRQWIGPEEAEELLDFDIATQVSEEGPLNPGINPFRQPGLTDGEKEEYCKILQPRLQALREEYKEGSLNSESAGKYRRVRYLRYSDLRVLSLLYLFIGYLAFFVRKRGLGKQRQDIDIESKGTEEKFSKNEKGQTVNIRNCRILTIAICSFYIFLFIGIGIYAGKGEAQVIWRLPPLVVPVEDSEIIFWDCWAPEEPACQDFLGAMMHLKASTNISIQEGPTLGKWAKEIWATLFKKATRQCRRGKVWRKWNETITGPKGCANNTCYNVTVSIPDYQCYLDRVDTWLQGKVNISLCLTGGKMLYNKETKQLSYCTDPLQIPLINYTFGPNQTCMWNTSLIKNPDIPKCGWWNQAVYYNSCRWEKADVQFQCQRTQSQPGTWLRKISSWKQKNRWEWRPDFESERVKISLQCNSTKNLTFAMRSSSDYSDVVGAWIEFGCHRNKSRRHTDARFRIRCKWNVGSNTSLIDTCGKENITGANPVDCTMTAKTLYNCSLQEGFTMKIEDLIMHFNMTKAVEMYEIAGNWSCKSDLPTDWGYMKCNCTSRNESEKMKCPAKDGILRNWYNPVAGLRQALDKYQVVKQPDYIVVPEEVLNYQSRQKRAAIHIMLALATVLSIAGAGTGATAIGMVTQYHQVLATHQEALDKITEALKINNLRLVTLEHQVLVIGLKVEATEKRLYTAFAMQELGCNQNQFFCKIPCELWMRYNLTLNQTIWNHGNVTLQDWYNQTKQLQQKFYEIIMDIEQNNVQGKKGIQQLQSWEYWTGWMGKIPQYLKGLLGGVLGIGLGILLLILCLPTLLDCMRNCINKVMGYTVIVMPEIDDEELSQNMELRRNGRQCGMSEKEEE

SEQ ID NO: 399 - protein, 853 aa, Artificial sequence
  Mutated sequence
MAEGFCQNRQWIGPEEAEELLDFDIATQVSEEGPLNPGINPFRQPGLTDGEKEEYCKILQPRLQALREEYKEGSLNSESAGKYRRVRYLRYSDLRVLSLLYLFIGYLAFFVRKRGLGKQRQDIDIESKGTEEKFSKNEKGQTVNIRNCRILTIAICSFYIFLFIGIGIYAGKGEAQVIWRLPPLVVPVEDSEIIFWDCWAPEEPACQDFLGAMMHLKASTNISIQEGPTLGKWAKEIWATLFKKATRQCRRGKVWRKWNETITGPKGCANNTCYNVTVSIPDYQCYLDRVDTWLQGKVNISLCLTGGKMLYNKETKQLSYCTDPLQIPLINYTFGPNQTCMWNTSLIKNPDIPKCGWWNQAVYYNSCRWEKADVQFQCQRTQSQPGTWLRKISSWKQKNRWEWRPDFESERVKISLQCNSTKNLTFAMRSSSDYSDVVGAWIEFGCHRNKSRRHTDARFRIRCKWNVGSNTSLIDTCGKENITGANPVDCTMTAKTLYNCSLQEGFTMKIEDLIMHFNMTKAVEMYEIAGNWSCKSDLPTDWGYMKCNCTSRNESEKMKCPAKDGILRNWYNPVAGLRQALDKYQVVKQPDYIVVPEEVLNYQSRQKRAAIHIMLALATVLSIAGAGTGATAIGMVTQYHQVLATHQEALDKITEALKINNLRLVTLEHQVLVIGLKVEATEKFRYTAFAMQELGCNQNQFFCKIPCELWMRYNLTLNQTIWNHGNVTLQDWYNQTKQLQQKFYEIIMDIEQNNVQGKKGIQQLQSWEYWTGWMGKIPQYLKGLLGGVLGIGLGILLLILCLPTLLDCMRNCINKVMGYTVIVMPEIDDEELSQNMELRRNGRQCGMSEKEEE

SEQ ID NO: 400 - protein, 851 aa, Artificial sequence
  Mutated sequence
MAEGGFAQNQQWIGPEEAEELLDFDIAVQMNEEGPLNPGVNPFRVPGITPQEKDNYCTILQPRLQELKREIKEVKIEEENAGKFRRARFLRYSDENVLSIVYLLTGYLRYLIDRKSLGSLRHDIDIEVPQKEQYSNNEKGNTVNRKYGRICCISTLFLYLLLFAGIGVWYGTTAQVVWRLPPLVVPIDDTEIIFWDCWAPEEPACQDFLGAMIHLKANINISIQEGPTLGNWAREIWSTLFKKATRQCRRGRIWRRWNETITGPLGCANNTCYNISVVIPDYQCYVDRVDTWLQGKVNISLCLTGGKMLFNKETKQLSYCTDPLQIPLINYTFGPNQTCEWNTSLIKDPEIPKCGWWNQNAYYNSCKWEQTDVKFQCQRIQSQPGSWIRAISSWRQRNRWEWRPDFESEKVKISLQCNSTRNLTFAMRSSSDYYDVQGAWIEFGCYRNKSIRHTGTRFRIRCRWNEGKNMSLIDTCGTDPNVTRANPVNCTLKTNTMYNCTLQDSFTMKIEDLIVHFNMSKAVEMYNIAGNWSCTSDLPTGWGYMKCNCTSTNNTGKMKCPEPEGILRNWYNPVAGLRQALMKYQVVKQPEYLIVPEEVMKYKSKQKRAAIHIMLALATVLSIAGAGTGATAIGMVTQYHQVLATHQQALEKITEALKINNLRLVTLEHQVLMIGLKVEAIEKRLYTAFAMQELGCNQNQFFCKIPLNLWTMYNMTINQTLWNHGNITLGDWYNQTKGLQEKFYEIIMDLEQNNVQGKLGIQQLQKWENWVGWIGKIPQYLKGLLGSVLGIGVGILLLIICLPTLVDCIRNCINKVLGYSVIAMPELDDEEVSMELRRNGRQCGMSEKEEE

SEQ ID NO: 401 - protein, 851 aa, Artificial sequence
  Mutated sequence
MAEGGFAQNQQWIGPEEAEELLDFDIAVQMNEEGPLNPGVNPFRVPGITPQEKDNYCTILQPRLQELKREIKEVKIEEENAGKFRRARFLRYSDENVLSIVYLLTGYLRYLIDRKSLGSLRHDIDIEVPQKEQYSNNEKGNTVNRKYGRICCISTLFLYLLLFAGIGVWYGTTAQVVWRLPPLVVPIDDTEIIFWDCWAPEEPACQDFLGAMIHLKANINISIQEGPTLGNWAREIWSTLFKKATRQCRRGRIWRRWNETITGPLGCANNTCYNISVVIPDYQCYVDRVDTWLQGKVNISLCLTGGKMLFNKETKQLSYCTDPLQIPLINYTFGPNQTCEWNTSLIKDPEIPKCGWWNQNAYYNSCKWEQTDVKFQCQRIQSQPGSWIRAISSWRQRNRWEWRPDFESEKVKISLQCNSTRNLTFAMRSSSDYYDVQGAWIEFGCYRNKSIRHTGTRFRIRCRWNEGKNMSLIDTCGTDPNVTRANPVNCTLKTNTMYNCTLQDSFTMKIEDLIVHFNMSKAVEMYNIAGNWSCTSDLPTGWGYMKCNCTSTNNTGKMKCPEPEGILRNWYNPVAGLRQALMKYQVVKQPEYLIVPEEVMKYKSKQKRAAIHIMLALATVLSIAGAGTGATAIGMVTQYHQVLATHQQALEKITEALKINNLRLVTLEHQVLMIGLKVEAIEKFRYTAFAMQELGCNQNQFFCKIPLNLWTMYNMTINQTLWNHGNITLGDWYNQTKGLQEKFYEIIMDLEQNNVQGKLGIQQLQKWENWVGWIGKIPQYLKGLLGSVLGIGVGILLLIICLPTLVDCIRNCINKVLGYSVIAMPELDDEEVSMELRRNGRQCGMSEKEEE

SEQ ID NO: 402 - protein, 855 aa, Artificial sequence
  Mutated sequence
MAEGGFTQNHQWIGPEEAEELLDFDIAIQMNEEGPLNPGVNPFRVPGITSQEKDDYCKILQTKLQELKNEVKEVKIEEGNAGKFRRARFLRYSDENVLSIVYLLIGYLRYLIDHRSLGSLRHDIDIEAPQEEHYNNSEKGTTLNIKYGRRCCISTFIMYLILFAGVGIWFGARAQVVWRLPPLVVPVDDTEIIFWDCWAPEEPACQDFLGTMIHLKAKTNISIQEGPTLGNWAREIWATLFKKATRQCRRGRIWRRWNETITGPLGCANNTCYNISVVVPDYQCYLDRVDTWLQGKLNISLCLTGGKMLYNKVTKQLSYCTDPLQIPLINYTFGPNQTCMWNTSQIQDPEIPKCGWWNQMAYYNSCKWEEAKVKFHCQRTQSQPGSWHRAISSWKQRNRWEWRPDFKSKKVKISLQCNSTKNLTFAMRSSSDYYDVQGAWIEFGCHRNKSKGFSEARFRTRCKWNEGNNISLIDTCGTNPNVTGANPVDCTMKANIMYNCSLQDSFTMKIEDLIVHFNMTKAVEMYNIAGNWSCTSDLPKGWGYMNCNCTNGTDNSKTKMACPRNQGILRNWYNPVAGLRQALIKYQVVKQPEYLIVPEEVMQYKVKQKRAAIHIMLALATVLSMAGAGTGATAIGMVTQYHQVLATHQHALDKITEALKINNLRLITLVHQVLVIGLKVRAIEKRLYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTHKILGYTVIAMPEIDDEEVHLSVELRRNGRQCGISEKEEE

SEQ ID NO: 403 - protein, 855 aa, Artificial sequence
  Mutated sequence
MAEGGFTQNHQWIGPEEAEELLDFDIAIQMNEEGPLNPGVNPFRVPGITSQEKDDYCKILQTKLQELKNEVKEVKIEEGNAGKFRRARFLRYSDENVLSIVYLLIGYLRYLIDHRSLGSLRHDIDIEAPQEEHYNNSEKGTTLNIKYGRRCCISTFIMYLILFAGVGIWFGARAQVVWRLPPLVVPVDDTEIIFWDCWAPEEPACQDFLGTMIHLKAKTNISIQEGPTLGNWAREIWATLFKKATRQCRRGRIWRRWNETITGPLGCANNTCYNISVVVPDYQCYLDRVDTWLQGKLNISLCLTGGKMLYNKVTKQLSYCTDPLQIPLINYTFGPNQTCMWNTSQIQDPEIPKCGWWNQMAYYNSCKWEEAKVKFHCQRTQSQPGSWHRAISSWKQRNRWEWRPDFKSKKVKISLQCNSTKNLTFAMRSSSDYYDVQGAWIEFGCHRNKSKGFSEARFRTRCKWNEGNNISLIDTCGTNPNVTGANPVDCTMKANIMYNCSLQDSFTMKIEDLIVHFNMTKAVEMYNIAGNWSCTSDLPKGWGYMNCNCTNGTDNSKTKMACPRNQGILRNWYNPVAGLRQALIKYQVVKQPEYLIVPEEVMQYKVKQKRAAIHIMLALATVLSMAGAGTGATAIGMVTQYHQVLATHQHALDKITEALKINNLRLITLVHQVLVIGLKVRAIEKPRYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTHKILGYTVIAMPEIDDEEVHLSVELRRNGRQCGISEKEEE

SEQ ID NO: 404 - protein, 854 aa, Artificial sequence
  Mutated sequence
MAEGFAANRQWIGPEEAEELLDFDKATQMNEEGPLNPGVNPFRVPAVTEADKQEYCKILQPRLQEIRNEIQEVKLEEGNAGKFRRARFLRYSDESILSLIHLFIGYCTYLVNRRRLGSLRHDINIEAPQEEQYSSREQGTTENIKYGRRCLIGTASLYLLLFIGVAIYLGTTNAQIVWRLPPLVVPVEESEIIFWDCWAPEEPACQDFLGAMIHLKASTNISIQEGPTLGNWAREIWGTLFKKATRHCRRNKIWKRWNETITGPVGCANNTCYNISVIIPDYQCYLDRVDTWLQGKVNISLCLTGGKMLYNRDTKQLSYCTDPLQIPLINYTFGPNQTCMWNTSQIQDPEIPKCGWWNQIAYYNSCRWESTNVKFYCQRTQSQPGTWIRTISSWRQKNRWEWRPDFESEKVKISLQCNSTHNLTFAMRSSGDYGEVMGAWIEFGCHRNKSRFHTEARFRIRCRWNVGDNTSLIDTCGKNLNVSGANPVDCTMYANKMYNCSLQNGFTMKVDDLIMHFNMTKAVEMYNIAGNWSCKSDLPQNWGYMNCNCTNGTSNDNKMACPEDKGILRNWYNPVAGLRQALEKYQVVKQPEYIVVPTEVMTYKYKQKRAAIHIMLALATVLSIAGAGTGATAIGMVTQYQQVLATHQEALDKITEALKINNLRLVTLEHQMLVIGLKVEAIEKRLYTAFAMQELGCNQNQFFCEIPKELWLRYNMTLNQTIWNHGNITLGEWYNQTKYLQQKFYEIIMDIEQNNVQGKQGLQKLQNWQDWMGWIGKIPQYLKGLLGGILGIGLGILLLILCLPTLVDCIRNCISKVLGYTVIAMPEIDDEEETVQMELRKNGRQCGMSEKEEE

SEQ ID NO: 405 - protein, 854 aa, Artificial sequence
  Mutated sequence
MAEGFAANRQWIGPEEAEELLDFDKATQMNEEGPLNPGVNPFRVPAVTEADKQEYCKILQPRLQEIRNEIQEVKLEEGNAGKFRRARFLRYSDESILSLIHLFIGYCTYLVNRRRLGSLRHDINIEAPQEEQYSSREQGTTENIKYGRRCLIGTASLYLLLFIGVAIYLGTTNAQIVWRLPPLVVPVEESEIIFWDCWAPEEPACQDFLGAMIHLKASTNISIQEGPTLGNWAREIWGTLFKKATRHCRRNKIWKRWNETITGPVGCANNTCYNISVIIPDYQCYLDRVDTWLQGKVNISLCLTGGKMLYNRDTKQLSYCTDPLQIPLINYTFGPNQTCMWNTSQIQDPEIPKCGWWNQIAYYNSCRWESTNVKFYCQRTQSQPGTWIRTISSWRQKNRWEWRPDFESEKVKISLQCNSTHNLTFAMRSSGDYGEVMGAWIEFGCHRNKSRFHTEARFRIRCRWNVGDNTSLIDTCGKNLNVSGANPVDCTMYANKMYNCSLQNGFTMKVDDLIMHFNMTKAVEMYNIAGNWSCKSDLPQNWGYMNCNCTNGTSNDNKMACPEDKGILRNWYNPVAGLRQALEKYQVVKQPEYIVVPTEVMTYKYKQKRAAIHIMLALATVLSIAGAGTGATAIGMVTQYQQVLATHQEALDKITEALKINNLRLVTLEHQMLVIGLKVEAIEKFRYTAFAMQELGCNQNQFFCEIPKELWLRYNMTLNQTIWNHGNITLGEWYNQTKYLQQKFYEIIMDIEQNNVQGKQGLQKLQNWQDWMGWIGKIPQYLKGLLGGILGIGLGILLLILCLPTLVDCIRNCISKVLGYTVIAMPEIDDEEETVQMELRKNGRQCGMSEKEEE

SEQ ID NO: 406 - protein, 855 aa, Artificial sequence
  Mutated sequence
MAEGGFTQNQQWIGPEEAEELLDFDIAVQMNEEGPLNPGVNPFRVPGITSQEKEDYCKILQTKLQELKNEVKGVKIEEGNAGKFRRARYLRYSDENVLSIVYLLIGYLRYLIDHRSLGSLRHDIDIETPQEEHFNNSEKGTTLNTKYGRRCCLSTFIMNLILFAGVGIWLGARAQVVWRLPPLVVPVDDTEIIFWDCWAPEEPACQDFLGTMVQLKASINISIQEGPTLGHWAREILETLFKKATRQCRRGRVWRRWNETITGPLGCANNACYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCQRTQSQPGTWLRAIASWEQANRWIWRPDFESDKVKISLQCNSTKNLTFAMRSSSDYYDVQGAWIEFGCHRNKSRRHSEARFRIRCKWNEGKNISLIDTCGTNPNVTGANPVDCTMKANTMYNCSLQDSFTMKIEDLIVHFNMTKAVEMYNIAGNWSCTSDLPKGWGYMNCNCTNGTDDSKTKMACPENQGILRNWYNPVAGLRQALIKYHVVKQPEYLIVPEEVMQYKVKQKRAAIHIMLALATVLSMAGAGTGATAIGMVTQYHQVLATHQQALDKITEALKINNLRLITLEHQVLVIGLKVEAIEKRLYTAFAMQELGCNQNQFFCKIPPSLWSMYNMTLNQTIWNHGNISLGNWYNQTRDLQNKFYEIIMDIEQNNVQGKTGIQQLQKWENWMGWIGKIPQYLKGLLGSVLGIGLGILLLLICLPTLVDCIRNCTNKILGYTVIAMPEIDDEEVHLSVELRRNGRQCGISEKEEE

SEQ ID NO: 407 - protein, 855 aa, Artificial sequence
  Mutated sequence
MAEGGFTQNQQWIGPEEAEELLDFDIAVQMNEEGPLNPGVNPFRVPGITSQEKEDYCKILQTKLQELKNEVKGVKIEEGNAGKFRRARYLRYSDENVLSIVYLLIGYLRYLIDHRSLGSLRHDIDIETPQEEHFNNSEKGTTLNTKYGRRCCLSTFIMNLILFAGVGIWLGARAQVVWRLPPLVVPVDDTEIIFWDCWAPEEPACQDFLGTMVQLKASINISIQEGPTLGHWAREILETLFKKATRQCRRGRVWRRWNETITGPLGCANNACYNISVVVPDYQCYVDRVDTWLQGRINISLCLTGGKMLYNKDTQQLSYCTEPLQIPLINYTFGPNQTCMWNTSLIEDSEIPKCGWWNQAAYYNSCKWEQTDVKFQCQRTQSQPGTWLRAIASWEQANRWIWRPDFESDKVKISLQCNSTKNLTFAMRSSSDYYDVQGAWIEFGCHRNKSRRHSEARFRIRCKWNEGKNISLIDTCGTNPNVTGANPVDCTMKANTMYNCSLQDSFTMKIEDLIVHFNMTKAVEMYNIAGNWSCTSDLPKGWGYMNCNCTNGTDDSKTKMACPENQGILRNWYNPVAGLRQALIKYHVVKQPEYLIVPEEVMQYKVKQKRAAIHIMLALATVLSMAGAGTGATAIGMVTQYHQVLATHQQALDKITEALKINNLRLITLEHQVLVIGLKVEAIEKFRYTAFAMQELGCNQNQFFCKIPPSLWSMYNMTLNQTIWNHGNISLGNWYNQTRDLQNKFYEIIMDIEQNNVQGKTGIQQLQKWENWMGWIGKIPQYLKGLLGSVLGIGLGILLLLICLPTLVDCIRNCTNKILGYTVIAMPEIDDEEVHLSVELRRNGRQCGISEKEEE

SEQ ID NO: 408 - protein, 855 aa, Artificial sequence
  Mutated sequence
MAEGGFTQNQQWIGPEEAEELLDFDIAVQMNEEGPLNPGVNPFRVPGITSQEKEDYCKTLQTNLQELKNEVKEVKIEEGNAGKFRRARFLRYSDENVLSIVYLLIGYLRYLIDHRSLGSLRHDIDIEAPQEEHYNNSEKGTTLNIKYARRCCISTFIMYLILFAGVGIWLGARAQVVWRLPPLVVPVDDTEIIFWDCWAPEEPACQDFLGTMVQLKASINIGIQEGPTLGHWAREIWSTLFKKATRQCRRGRVWRRWNETITGPLGCANNTCYNISVVVPDYQCYVDRVDTWLQGRINISLCLTGGKMLYNKDTHQLSYCTEPLQIPLINCTFGPIQTCMWNTSLIQDPEIPKCGWWTQVAYYNNCKWEEANVTFQCHRTQSRSGSWLRTISSWRQRNRWEWRPDFESEKVKISLQCNSTKNLTFAMRSSSDYYDVQGAWIEFGCHRNKSKKHSEARFRIRCKWNEGNNISLIDTCGTNPNVTGANPVDCTMKANTMYNCSLQDSFTMKIEDLIVHFNMTKAVEMYNIAGNWSCTSDLPKGWGYMNCNCTNGTDDSKTKMACPENQGILRNWYNPVAGLRQALIKYQVVKQPEYLIVPEEVMQYKVKQKRAAIHIMLALATVLSMAGAGTGATAIGMVTQYHQVLATHQQALDKITEALKINNLRLITLEHQVLVIGLKVEAIEKRLYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 409 - protein, 855 aa, Artificial sequence
  Mutated sequence
MAEGGFTQNQQWIGPEEAEELLDFDIAVQMNEEGPLNPGVNPFRVPGITSQEKEDYCKTLQTNLQELKNEVKEVKIEEGNAGKFRRARFLRYSDENVLSIVYLLIGYLRYLIDHRSLGSLRHDIDIEAPQEEHYNNSEKGTTLNIKYARRCCISTFIMYLILFAGVGIWLGARAQVVWRLPPLVVPVDDTEIIFWDCWAPEEPACQDFLGTMVQLKASINIGIQEGPTLGHWAREIWSTLFKKATRQCRRGRVWRRWNETITGPLGCANNTCYNISVVVPDYQCYVDRVDTWLQGRINISLCLTGGKMLYNKDTHQLSYCTEPLQIPLINCTFGPIQTCMWNTSLIQDPEIPKCGWWTQVAYYNNCKWEEANVTFQCHRTQSRSGSWLRTISSWRQRNRWEWRPDFESEKVKISLQCNSTKNLTFAMRSSSDYYDVQGAWIEFGCHRNKSKKHSEARFRIRCKWNEGNNISLIDTCGTNPNVTGANPVDCTMKANTMYNCSLQDSFTMKIEDLIVHFNMTKAVEMYNIAGNWSCTSDLPKGWGYMNCNCTNGTDDSKTKMACPENQGILRNWYNPVAGLRQALIKYQVVKQPEYLIVPEEVMQYKVKQKRAAIHIMLALATVLSMAGAGTGATAIGMVTQYHQVLATHQQALDKITEALKINNLRLITLEHQVLVIGLKVEAIEKFRYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 410 - protein, 855 aa, Artificial sequence
  Mutated sequence
MAEGGFTHNQQWIGPEEAEELLDFDIAVQMNEEGPLNPGVNPFRVPGITSQEKDDYCKILQTKLQELKNEVKEVKIEEGNAGKFRRARYLRYSDENVLSIVYLLIGYLRYLIDHRSLGSLRHDIDIETPQEEHYNNSEKGTTLNIKYGRRCCISTFIMYLILFAGVGIWLGARAQVVWRLPPLVVPVDDTEIIFWDCWAPEEPACQDFLGTMIYLKANVNISIQEGPTLGNWAREIWSTLFKKATRQCRRGRIWRRWNETITGPLGCANNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYDTCKWEEANVTFQCHRTQSQSGSWIRTISSWKQRNRWEWRPDFESEKVKISLQCNSTKNLTFAMRSSSDYYDVQGAWIEFGCHRNKSKRHSEARFRIRCKWNEGNNISLIDTCGTNPNVTGANPVDCTMKANTMYNCSLQDSFTMKIEDLIVHFNMTKAVELYNIAGNWSCTSDLPKGWGYMNCNCTNGTDNSETKMACPKNQGILRNWYNPVAGLRQALIKYQVVKQPEYLIVPEEVMQYKFKQKRAAIHIMLALATVLSMAGAGTGATAIGMVTQYHQVLATHQQALEKITEALKINNLRLITLEHQVLVIGLRVEAIEKRLYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 411 - protein, 855 aa, Artificial sequence
  Mutated sequence
MAEGGFTHNQQWIGPEEAEELLDFDIAVQMNEEGPLNPGVNPFRVPGITSQEKDDYCKILQTKLQELKNEVKEVKIEEGNAGKFRRARYLRYSDENVLSIVYLLIGYLRYLIDHRSLGSLRHDIDIETPQEEHYNNSEKGTTLNIKYGRRCCISTFIMYLILFAGVGIWLGARAQVVWRLPPLVVPVDDTEIIFWDCWAPEEPACQDFLGTMIYLKANVNISIQEGPTLGNWAREIWSTLFKKATRQCRRGRIWRRWNETITGPLGCANNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYDTCKWEEANVTFQCHRTQSQSGSWIRTISSWKQRNRWEWRPDFESEKVKISLQCNSTKNLTFAMRSSSDYYDVQGAWIEFGCHRNKSKRHSEARFRIRCKWNEGNNISLIDTCGTNPNVTGANPVDCTMKANTMYNCSLQDSFTMKIEDLIVHFNMTKAVELYNIAGNWSCTSDLPKGWGYMNCNCTNGTDNSETKMACPKNQGILRNWYNPVAGLRQALIKYQVVKQPEYLIVPEEVMQYKFKQKRAAIHIMLALATVLSMAGAGTGATAIGMVTQYHQVLATHQQALEKITEALKINNLRLITLEHQVLVIGLRVEAIEKFRYTAFAMQELGCNQNQFFCKIPPSLWSMYNMTLNQTIWNHGNISLGNWYNQTRDLQNKFYEIIMDIEQNNVQGKTGIQQLQKWENWVGWIGKIPQYLKGLLGSVLGIGLGILLLLICLPTLVDCIRNCTNKILGYTVIAMPEIDDEEVHLSVELRRNGRQCGISEKEEE

SEQ ID NO: 412 - protein, 853 aa, Artificial sequence
  Mutated sequence
MAEGGFTQNQQWIGPEEAEELLDFDIAVQMNEEGPLHPGINPFRVPGITPQEKEDYCKILQPKLQELKGEIKEVKLEERNAGKFRRARYLRYSDENVLSIIYLLTGYFRYLINHRSLGALRHDIDIEAPQKEQYSNNEKGTTLNIKYGRVCCISTLLLYLLLFAGLGVWYGTSAQVVWRLPPLVVPVEDTEIIFWDCWAPEEPACQDFLGTMIHLKANVNISIQEGPTLGNWAREIWSTLFKKATRQCRRGRIWRRWNETITGPLGCANNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYNACKWEEANVTFQCHRTQSQPGSWIRTISSWKQRNRWEWRPDFESEKVKISLQCNSTKNLTFAMRSSSDYYDIQGAWIEFGYHRNKSKMHSEVRFRIRCKWNEGNNISLIDTCGTNPNVTGANPVDCTMKANTMYNCSLQDSFTMKIEDLIVHFNMTKAVEMYNIAGNWSCTSDLPKGWGYMNCNCTNGTDESGTKMACPKSQGILRNWYNPVAGLRQALIKYQVVKQPEYLIVPEEVMQYKFKQKRAAIHIMLALATVLSMAGAGTGATAIGMVTQYHQVLATHQQALDKITQALKINNLRLITLEHQVLVIGLKVEAIEKRLYTAFAMQELGCNQNQFFCKIPPSLWSMYNMTLNQTIWNHGNISLGNWYNQTKDLQNKFYEIIMDIEQNNVQGKTGIQQLQKWENWVGWIGKIPQYLKGLLGSVLGIGVGILLLIICLPTLVDCVRNCINKVLGYSVIAMPELDDEEVSMELRRNGRQCGMSEKEEE

SEQ ID NO: 413 - protein, 853 aa, Artificial sequence
  Mutated sequence
MAEGGFTQNQQWIGPEEAEELLDFDIAVQMNEEGPLHPGINPFRVPGITPQEKEDYCKILQPKLQELKGEIKEVKLEERNAGKFRRARYLRYSDENVLSIIYLLTGYFRYLINHRSLGALRHDIDIEAPQKEQYSNNEKGTTLNIKYGRVCCISTLLLYLLLFAGLGVWYGTSAQVVWRLPPLVVPVEDTEIIFWDCWAPEEPACQDFLGTMIHLKANVNISIQEGPTLGNWAREIWSTLFKKATRQCRRGRIWRRWNETITGPLGCANNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYNACKWEEANVTFQCHRTQSQPGSWIRTISSWKQRNRWEWRPDFESEKVKISLQCNSTKNLTFAMRSSSDYYDIQGAWIEFGYHRNKSKMHSEVRFRIRCKWNEGNNISLIDTCGTNPNVTGANPVDCTMKANTMYNCSLQDSFTMKIEDLIVHFNMTKAVEMYNIAGNWSCTSDLPKGWGYMNCNCTNGTDESGTKMACPKSQGILRNWYNPVAGLRQALIKYQVVKQPEYLIVPEEVMQYKFKQKRAAIHIMLALATVLSMAGAGTGATAIGMVTQYHQVLATHQQALDKITQALKINNLRLITLEHQVLVIGLKVEAIEKFRYTAFAMQELGCNQNQFFCKIPPSLWSMYNMTLNQTIWNHGNISLGNWYNQTKDLQNKFYEIIMDIEQNNVQGKTGIQQLQKWENWVGWIGKIPQYLKGLLGSVLGIGVGILLLIICLPTLVDCVRNCINKVLGYSVIAMPELDDEEVSMELRRNGRQCGMSEKEEE

SEQ ID NO: 414 - protein, 855 aa, Artificial sequence
  Mutated sequence
MAEGGFTQNQQWIGPEEAEELLDFDIAVQMNEEGPLNPGVNPFRVPGITSQEKDDYCKVLQTKLQELKNEVKEVKIEEGNAGKFRRARYLRYSDENVLSIVYLLIGYLRYLIDHRSLGSLRHDIDIETPQEEHYNNSEKGTTLNTKYGRRCCLSTFIMYLVLFAGVGLWLGARAQVVWRLPPLVVPVDDTEIIFWDCWAPEEPACQDFLGTMIYLKANVNISIQEGPTLGNWAREIWSTLFKKATRQCRRGRIWKRWNETITGPLGCATNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYNACKWEEANVTFQCQRTQSQSGSWIRTISSWKQRNRWEWRPDFESEKVKISLQCNSTKNLTFAMRSSSDYYDVQGAWIEFGCHRNKSKKYSEARFRIRCKWNEGKNISLIDTCGTNPNVTGANPVDCTMKANTMYNCSLQDSFTMKIEDLIVHFNMTKAVEMYNIAGNWSCTSDLPKGWGYMNCNCTNGTDNSETKMTCPENQGILRNWYNPVAGLRQALIKYQVVKQPEYLIVPEEVMQYKFKQKRAAIHIMLALATVLSMAGAGTGATAIGMVTQYHQVLATHQQALEKITEALKINNLRLITLEHQVLVIGLKVEAIEKRLYTAFAMQELGCHQNQFFCKIPPSLWSMYNMTLNQTIWNHGNISLGNWYNQTRDLQNKFYEIIMDIEQNNVQGKTGIQQLQKWENWMGWIGKIPQYLKGLLGSVLGIGLGILLLLICLPTLVDCIRNCTNKILGYTVIAMPEIDDEEVHLSVELRRNGRQCGISEKEEE

SEQ ID NO: 415 - protein, 855 aa, Artificial sequence
  Mutated sequence
MAEGGFTQNQQWIGPEEAEELLDFDIAVQMNEEGPLNPGVNPFRVPGITSQEKDDYCKVLQTKLQELKNEVKEVKIEEGNAGKFRRARYLRYSDENVLSIVYLLIGYLRYLIDHRSLGSLRHDIDIETPQEEHYNNSEKGTTLNTKYGRRCCLSTFIMYLVLFAGVGLWLGARAQVVWRLPPLVVPVDDTEIIFWDCWAPEEPACQDFLGTMIYLKANVNISIQEGPTLGNWAREIWSTLFKKATRQCRRGRIWKRWNETITGPLGCATNTCYNISVVVPDYQCYVDRVDTWLQGKVNISLCLTGGKMLYNKETRQLSYCTDPLQIPLINYTFGPNQTCMWNTSLIKDSEIPKCGWWNQVAYYNACKWEEANVTFQCQRTQSQSGSWIRTISSWKQRNRWEWRPDFESEKVKISLQCNSTKNLTFAMRSSSDYYDVQGAWIEFGCHRNKSKKYSEARFRIRCKWNEGKNISLIDTCGTNPNVTGANPVDCTMKANTMYNCSLQDSFTMKIEDLIVHFNMTKAVEMYNIAGNWSCTSDLPKGWGYMNCNCTNGTDNSETKMTCPENQGILRNWYNPVAGLRQALIKYQVVKQPEYLIVPEEVMQYKFKQKRAAIHIMLALATVLSMAGAGTGATAIGMVTQYHQVLATHQQALEKITEALKINNLRLITLEHQVLVIGLKVEAIEKFRYTAFAMQELGCHQNQFFCKIPPSLWSMYNMTLNQTIWNHGNISLGNWYNQTRDLQNKFYEIIMDIEQNNVQGKTGIQQLQKWENWMGWIGKIPQYLKGLLGSVLGIGLGILLLLICLPTLVDCIRNCTNKILGYTVIAMPEIDDEEVHLSVELRRNGRQCGISEKEEE

SEQ ID NO: 416 - protein, 853 aa, Artificial sequence
  Mutated sequence
MAEGGFTQNQQWIGPEEAEELLDFDIAVQMNEEGPLNPGVNPFRVPGITSQEKDDYCKILQTKLRELKNEVKEVKIEEGNAGKLRRARYLRYSDENVLSIVYLLIGYLRYLIDHRSLGSLRHDIDIETPQEEHYNNSEKGTTLNIKYEGRCCLSTFIMHLILFAGVGIWLGARAQVVWRLPPLVVPVDDTEMIFWDCWAPEEPACQDFLGTMIHLKANVNISIQEGPTLGNWAREIWSTLFKKATRQCRRGKIWRRWNETITGPLGCANNTCYNISVVVPDYQCYVDRVDTWLQGKVNISLCLTGGKMLYNKETRQLSYCTDPLQIPLINYTFGPNQTCMWNASLIKDSEIPKCGWWNQAAYYNACKWEEANVTFQCHRTQSQSGSWIRTISSWRQRNRWEWRPDFESEKVKISLQCNSTKNLTFAMRSSSDYYDVQGAWIEFGCHRKKSNKHSEARFRIRCTWNEGNNISLIDTCGTNPNVTGANPVDCTMKANVMYNCTLQDSFTMKIEDLIVHFNMTKAVEMYNIAGNWSCTSDLPKGWGYMNCNCTNGTDNTKMTCPKNQGILRNWYNPVAGLRQALIKYQVVKQPEYLIVPEEVMQYKVKQKRAAIHIMLALATVLSMAGAGTGATAIGMVTQYHQVLATHQQALDKITEALKINNLRLITLEHQVLVIGLKVEAIEKRLYTAFAMQELGCNQNQFFCKIPPSLWSMYNMTLNQTIWNHGNISLGNWYNQTKDLQNKFYEIIMDIEQNNVQGKTGIQQLQKWENWVGWIGKIPQYLKGLLGSVLGIGLGILLLLICLPTLVDCIRSCTNRILGYTVIAMPEIDDEEVHLSVELRRNGRQCGISEKEEE

SEQ ID NO: 417 - protein, 853 aa, Artificial sequence
  Mutated sequence
MAEGGFTQNQQWIGPEEAEELLDFDIAVQMNEEGPLNPGVNPFRVPGITSQEKDDYCKILQTKLRELKNEVKEVKIEEGNAGKLRRARYLRYSDENVLSIVYLLIGYLRYLIDHRSLGSLRHDIDIETPQEEHYNNSEKGTTLNIKYEGRCCLSTFIMHLILFAGVGIWLGARAQVVWRLPPLVVPVDDTEMIFWDCWAPEEPACQDFLGTMIHLKANVNISIQEGPTLGNWAREIWSTLFKKATRQCRRGKIWRRWNETITGPLGCANNTCYNISVVVPDYQCYVDRVDTWLQGKVNISLCLTGGKMLYNKETRQLSYCTDPLQIPLINYTFGPNQTCMWNASLIKDSEIPKCGWWNQAAYYNACKWEEANVTFQCHRTQSQSGSWIRTISSWRQRNRWEWRPDFESEKVKISLQCNSTKNLTFAMRSSSDYYDVQGAWIEFGCHRKKSNKHSEARFRIRCTWNEGNNISLIDTCGTNPNVTGANPVDCTMKANVMYNCTLQDSFTMKIEDLIVHFNMTKAVEMYNIAGNWSCTSDLPKGWGYMNCNCTNGTDNTKMTCPKNQGILRNWYNPVAGLRQALIKYQVVKQPEYLIVPEEVMQYKVKQKRAAIHIMLALATVLSMAGAGTGATAIGMVTQYHQVLATHQQALDKITEALKINNLRLITLEHQVLVIGLKVEAIEKFRYTAFAMQELGCNQNQFFCKIPPSLWSMYNMTLNQTIWNHGNISLGNWYNQTKDLQNKFYEIIMDIEQNNVQGKTGIQQLQKWENWVGWIGKIPQYLKGLLGSVLGIGLGILLLLICLPTLVDCIRSCTNRILGYTVIAMPEIDDEEVHLSVELRRNGRQCGISEKEEE

SEQ ID NO: 418 - protein, 855 aa, Artificial sequence
  Mutated sequence
MADGGFSQNQQWIGPEEAEKSLDFDIATQMNEEGPLNPGVNPFRVPGITPQEKEDYCKILQTRLQELKNELKEVKVEQRNAGKFRRTRFLRYSDENVLSIVYLLIGYLRYLIDRRSLGSLRHDIDIKIPQEEHYNNSAKDTTLNIKYERRCCIGTFIMYLILFAGIGIWFGAKAQVVWRLPPLVVPVEESEIIFWDCWAPEEPACQDFLGAMIHLKANTNISIQEGPTLGNWAREIWSTLFKKATKQCRKGGIWTKWKETITGPLGCANNTCYNISVVVPDYQCYVDRVDTWLQGKVNISLCLTGGKMLFNKETKQLSYCTDPLQIPLINYTFGPNQTCMWNTSQIQDSEIPKCGWWNQIAYYNSCQWEKTDVKFHCQRTQSQPGSWRRAISSWRQRNRWEWRPDFESKKVKVSLKCNSTKNLTFAMRSSGDYGEVTGAWIEFGCHRNKSKLHTEARFRIRCKWNEGNNISLIDTCGTNPNVAEANPVDCTMKANTMYNCSLQDSFTMKIEDLIVHFNMTKAVEMYNIAGNWSCTSDLPKGWGYMNCNCTNGTTSNGIKMACPKQQGILRNWYNPVAGLRQALIKYQVVKQPEYLIVPEEVLQYKFKQKRAAIHIMLALATVLSMAGAGTGATAIGVVTQYHQVLATHQQALDKITEALKINNLRLITLEHQVLVIGLKVEAIEKRLYTAFAMQELGCNQNQFFCKIPLNLWNMYNMTLNQTIWNHGNISLGNWYNQTRDLQNKFYEIIMDIEQNNVQGHTGIQQLQKWENWVGWIGKIPQYLKGLIGSVLGIGLGILLLLICLPTLVDCIRSCTNKMLGYTVIAMPEIGDEGVHLAMELRRNGRQCGISEKEEE

SEQ ID NO: 419 - protein, 855 aa, Artificial sequence
  Mutated sequence
MADGGFSQNQQWIGPEEAEKSLDFDIATQMNEEGPLNPGVNPFRVPGITPQEKEDYCKILQTRLQELKNELKEVKVEQRNAGKFRRTRFLRYSDENVLSIVYLLIGYLRYLIDRRSLGSLRHDIDIKIPQEEHYNNSAKDTTLNIKYERRCCIGTFIMYLILFAGIGIWFGAKAQVVWRLPPLVVPVEESEIIFWDCWAPEEPACQDFLGAMIHLKANTNISIQEGPTLGNWAREIWSTLFKKATKQCRKGGIWTKWKETITGPLGCANNTCYNISVVVPDYQCYVDRVDTWLQGKVNISLCLTGGKMLFNKETKQLSYCTDPLQIPLINYTFGPNQTCMWNTSQIQDSEIPKCGWWNQIAYYNSCQWEKTDVKFHCQRTQSQPGSWRRAISSWRQRNRWEWRPDFESKKVKVSLKCNSTKNLTFAMRSSGDYGEVTGAWIEFGCHRNKSKLHTEARFRIRCKWNEGNNISLIDTCGTNPNVAEANPVDCTMKANTMYNCSLQDSFTMKIEDLIVHFNMTKAVEMYNIAGNWSCTSDLPKGWGYMNCNCTNGTTSNGIKMACPKQQGILRNWYNPVAGLRQALIKYQVVKQPEYLIVPEEVLQYKFKQKRAAIHIMLALATVLSMAGAGTGATAIGVVTQYHQVLATHQQALDKITEALKINNLRLITLEHQVLVIGLKVEAIEKFRYTAFAMQELGCNQNQFFCKIPLNLWNMYNMTLNQTIWNHGNISLGNWYNQTRDLQNKFYEIIMDIEQNNVQGHTGIQQLQKWENWVGWIGKIPQYLKGLIGSVLGIGLGILLLLICLPTLVDCIRSCTNKMLGYTVIAMPEIGDEGVHLAMELRRNGRQCGISEKEEE

SEQ ID NO: 420 - protein, 904 aa, Artificial sequence
  Mutated sequence
MDQDLDGAERGERGGGSEELLQEEINEGRLTAREALQTWINNGEIHPWVLAGMLSMGVGMLLGVYCQLPDTLIWILMFQLCLYWGLGETSRELDKDSWQWVRSVFIIAILGTLTMAGTALADDDQSTLIPNITKIPTKDTEPGCTYPWILILLILAFILGILGIILVLRRSNSEDILAARDTIDWWLSANQEIPPKFAFPIILISSPLAGIIGYYVMERHLEIFKKGCQICGSLSSMWGMLLEEIGRWLARREWNVSRVMVILLISFSWGMYVNRVNASGSHVAMVTSPPGYRIVNDTSQAPWYCFSSAPIPTCSSSQWGDKYFEEKINETLVKQVYEQAAKHSRATWIEPDLLEEAVYELALLSANDSRQVVVENGTDVCSSQNSSTNKGHPMTLLKLRGQVSETWIGNSSLQFCVQWPYVLVGLNNSDSNISFNSGDWIATNCMHPITLNKSAQDLGKNFPRLTFLDGQLSQLKNTLCGHNTNCLKFGNKSFSTNSLILCQDNPIGNDTFYSLSHSFSKQASARWILVKVPSYGFVVVNDTDTPPSLRIRKPRAVGLAIFLLVLAIMAITSSLVAATTLVNQHTTAKVVERVVQNVSYIAQTQDQFTHLFRNINNRLNVLHHRVSYLEYREEIRQKQVFFGCKPHGRYCHFDFGPEEVGWNNSWNSKTWNDLQDEYDKIEEKILKIRVDWLNSSLSDTQDTFGLETSIFDHLVQLFDWTSWKDWIKIIIVIIVLWLLIKILLGMLRSCAKVSQNYQHLPAEEEDGDTEPESSPARGDPASGSLYENWLNKIGESKNDAYRVWTEEYNSLRILFATCRWDLLTPQLLQLPFFLLTLLLKLLWDIFRHAPILNLKGWTVGQGGTSGQQQPPDFPYVNWTGSREQNNPEGGLDSGAWYEGLRGSQ

SEQ ID NO: 421 - protein, 9 aa, Artificial sequence
  Mutated sequence
  MISC_FEATURE (3)..(7): Xaa is any naturally occurring amino acid or is mutated
  MISC_FEATURE (8)..(8): Xaa is Ile or Val
  MISC_FEATURE (9)..(9): Xaa is Arg or His
YLXXXXXXX

SEQ ID NO: 422 - protein, 14 aa, Artificial sequence
  Mutated sequence
  MISC_FEATURE (2)..(2): Xaa is Ser or Thr
  MISC_FEATURE (5)..(9): Xaa is any naturally occurring amino acid or is mutated
  MISC_FEATURE (10)..(10): Xaa is Ile or Val
  MISC_FEATURE (11)..(11): Xaa is Arg or His
  MISC_FEATURE (12)..(12): Xaa is Glu or Gln
  MISC_FEATURE (13)..(13): Xaa is Lys or Leu or Val
VXYLXXXXXXXXXQ

SEQ ID NO: 423 - protein, 782 aa, Artificial sequence
  Mutated sequence
MMEEGRKEEPEERGEKSTMRDLLQRAVDKGHLTAREALDRWTLEDHGEIHPWIILFCFAGAIGVIGGWGLRGELNVCMLIALVVLVPIYWGIGEAARNIDSLDWQWVRKVFIVIILVLVGLLGGSCSAQRQHVAMLLSPPGIRLPSTVDIPWFCISNAPIPDCVHWTVQKPDQKHQQIENVMGLQEVLDNATFFEVPDLFDRVYLELARLDANSTGVPVNIPPTGIGQVKGDCSTGDIQGINETLSTRGTLGEKTFLSIRPGGWFTNTTVWFCVHWPFGFIQRKENLSEGSAQVRNCLDPINVTEPKVANYSYCPLEYKGKNYINKGLECVGGRVDLSSNPEQHTDLLACGTFCQNFRSCDMVSRDILIGYHPSQQRQHIYINHTFWEQANTRWILVQVPNYGFVPVPDTERPWKGGKTRGKRAVGMVIFLLVLAIMAMTASVTAAATLVKQHATAQVVGRLSTNLTYITRIQNQYLHLFQNLNTRVNNLHHRVTYLEFRAEVHEVQTGLGCVPRGRYCHFDWRPEEVGLNMTLWNSSTWQQWMSQYDQIEENIWNLKYNWSEALEKGKSNTDGLEPDVFRYLADLSSSFTWGSWVDKLVWLAYILLAYFAFKVLQCIMSNLGAQTRYQLLNAQEDTDPAEDGDQPDDHRSGDTPRSGVPSGGWSQRLSEGKRIGCLILRTEWQNWRNDLRTLRWLTLGGKILQLPLSLLVLLVRILLYILSPTFQNQRGWTVGRKGTGGDDRELSPELEYPSWTGSSQEMMEMRDLKEEDIPEEGIRPVEM

SEQ ID NO: 424 - protein, 9 aa, Artificial sequence
  Mutated sequence
  MISC_FEATURE (3)..(7): Xaa is any naturally occurring amino acid or is mutated
YLXXXXXVH

SEQ ID NO: 425 - protein, 14 aa, Artificial sequence
  Mutated sequence
  misc_feature (5)..(9): Xaa is any naturally occurring amino acid or is mutated
  misc_feature (13)..(13): Xaa is Leu or Val
VTYLXXXXXVHEXQ

SEQ ID NO: 426 - protein, 859 aa, Artificial sequence
  Mutated sequence
MVSIAFYGGIPGGISTPITQQSEKSKCEENTMFQPYCYNNDSKNSMAESKEARDQEMNLKEESKEEKRRNDWWKIGMFLLCLAGTTGGILWWYEGLPQQHYIGLVAIGGRLNGSGQSNAIECWGSFPGCRPFQNYFSYETNRSMHMDNNTATLLEAYHREITFIYKSSCTDSDHCQEYQCKKVNLNSSDSSNSVRVEDVMNTAEYWGFKWLECNQTENFKTILVPENEMVNINDTDTWIPKGCNETWARVKRCPIDILYGIHPIRLCVQPPFFLVQEKGIADTSRIGNCGPTIFLGVLEDNKGVVRGDYTACNVRRLNINRKDYTGIYQVPIFYTCTFTNITSCNNEPIISVIMYETNQVQYLLCNNNNSNNYNCVVQSFGVIGQAHLELPRPNKRIRNQSFNQYNCSINNKTELETWKLVKTSGITPLPISSEANTGLIRHKRDFGISAIVAAIVAATAIAASATMSYVALTEVNKIMEVQNHTFEVENSTLNGMDLIERQIKILYAMILQTHADVQLLKERQQVEETFNLIGCIERTHVFCHTGHPWNMSWGHLNESTQWDDWVSKMEDLNQEILTTLHGARNNLAQSMITFNTPDSIAQFGKDLWSHIGNWIPGLGASIIKYIVMFLLIYLLLTSSPKILRALWKVTSGAGSSGSRYLKKKFHHKHASREDTWDQAQHNIHLAGVTGGSGDKYYKQKYSRNDWNGESEEYNRRPKSWVKSIEAFGESYISEKTKGEISQPGAAINEHKNGSGGNNPHQGSLDLEIRSEGGNIYDCCIKAQEGTLAIPCCGFPLWLFWGLVIIVGRIAGYGLRGLAVIIRICIRGLNLIFEIIRKMLDYIGRALNPGTSHVSMPQYV

SEQ ID NO: 427 - protein, 9 aa, Artificial sequence
  Mutated sequence
  MISC_FEATURE (3)..(7): Xaa is any naturally occurring amino acid or is mutated
  MISC_FEATURE (8)..(8): Xaa is Val or Ile
LLXXXXXXE

SEQ ID NO: 428 - protein, 14 aa, Artificial sequence
  Mutated sequence
  MISC_FEATURE (2)..(2): Xaa is Gln or Arg
  MISC_FEATURE (5)..(9): Xaa is any naturally occurring amino acid or is mutated
  MISC_FEATURE (10)..(10): Xaa is Val or Ile
VXLLXXXXXXEETF

SEQ ID NO: 429 - protein, 944 aa, Artificial sequence
  Mutated sequence
MDAGARYMRLTGKENWVEVTMDGEKERKREGFTAGQQGKYQPQVSKQIGNRNTNPCFAYKGIFLWRISLTMWILLGINMCVSAEDYITLISDPYGFSPIKNVSGVPVTCVTKEFAKWGCQPLGAYPDPEIEYRNVSQEVVKEVYQENWPWNTYHWPLWQMENVRYWLKENMQENQQRKNNTKEGIEELLAGTIRGRFCVPYPFALLKCTKWCWYTAAINNESGKAGKIKINCTEARAVSCTEDMPLASIQRAYWDEKDRESMAFMNIKACDSNLRCQKRPGGCMEGYPIPVGAEIIPESMKYLRGAKSQYGGIKDKNGELKLPLTLRVWVKLANVSEWVNGTPPDWQDRINGSKGINGTLWGELNSMHHLGFALSQNGKWCNYTGEIKLGQETFQYHYKPNWNCTGNWTQYPVWQVIRNLDMVEHMTGECVQRPQRHNITVGNGTITGNCSTTNWDGCNCSRSGNYLYNSSEGGLLLILCRQNSTLTRILGTNTNWTTMWGIYKNCSGCENATLDNTGEGTLGGVANKNCSLPHKNESNKWTCAPRQRDGKTDSLYIAGGKKFWTRIKAQFSCESNIGQLDGMLHQQILLQKYQVIKVRAYTYGVIEMPENYAKTRIINRKKRELSHKRKKRGVGLVIMLVIMAIVAAAGASLGVANAIQQSYTKAAVQTLANATAAQQDVLEATYAMVQHVAKGVRILEARVARVEARTDRIMLYQELDCWHYHQYCITSTKTEVAKYINWTRFKDNCTWQQWERGLQGYDTNLTILLKESAAMTQLAEEQARRIPEVWESLKDVFDWSGWFSWLKYIPIIVVGLLGCILIRAVICVCQPLVQIYRTLSTPTYQRVTVIMETRADVAGENQDFGDGLEESDNSETSERVTVQKAWSRAWELWQNSPWKEPWKRGLLRLLVLPLTMGIWINGWLGEHHKNKKRKGDCETWAKED

SEQ ID NO: 430 - protein, 983 aa, Artificial sequence
  Mutated sequence
MASKESKPSRTTRRGMEPPLRETWNQVLQELVKRQQQEEEEQQGLVSGKKKSWVSIDLLGTEGKDIKKVNIWEPCEKWFAQVVWGVLWVLQIVLWGCLMWEVRKGNQCQAEEVIALVSDPGGFQRVQHVETVPVTCVTKNFTQWGCQPEGAYPDPELEYRNISREILEEVYKQDWPWNTYHWPLWQMENMRQWMKENEKEYKERTNKTKEDIDDLVAGRIRGRFCVPYPYALLRCEEWCWYPESINQETGHAEKIKINCTKAKAVSCTEKMSLAAVQRVYWEKEDEESMKFLNIKACNISLRCQDEGKSPGGCVQGYPIPKGAEIIPEAMKYLRGKKSRYGGIKDKNGELKLPLSVRVWVRMANLSGWVNGTPPYWSARINGSTGINGTRWYGIGTLHHLGCNISSNPERGICNFTGELWIGGDKFPYYYTPSWNCSQNWTGHPVWHVFRYLDMTEHMTSRCIQRPKRHNITVGNGTITGNCSVTNWDGCNCTRSGNHLYNSTSGGLLVIICRQNSTITGIMGTNTNWTTMWNIYQNCSRCNNSSLDRTGSGTLGTVNNLKCSLPHRNESNKWTCKSQRDSYIAGRDFWGKVKAKYSCESNLGGLDSMMHQQMLLQRYQVIRVRAYTYGVVEMPQSYMEAQGENKRSRRNLQRKKRGIGLVIVLAIMAIIAAAGAGLGVANAVQQSYTRTAVQSLANATAAQQEVLEASYAMVQHIAKGIRILEARVARVEARVDRMMVYQELDCWHYQHYCVTSTRSEVANYVNWTRFKDNCTWQQWEEEIEQHEGNLSLLLREAALQVHIAQRDARRIPDAWKAIQEAFNWSSWFSWLKYIPWIIMGIVGLMCFRILMCVISMCLQAYKQVKQIRYTQVTVVIEAPVELEEKQKRNGDGTNGCASLEHERRTSHRSFIQIWRATWWAWKTSPWRHNWRTMPYITLLPILVIWQWMEENGWNGENQHKKKKERVDCQDREQMPTLENDYVEL

SEQ ID NO: 431 - protein, 990 aa, Artificial sequence
  Mutated sequence
MASSKNMPSRITQKSMEPPLRETWQQVVQEMVMRKQRDEEEKQNLVTGKEKSWVSIDLLGTKQEGKRQKVNIWGPWEKWGIKIVWVMLWVIQLMLWGCLIWEMGKKHSCNAEEVIALVDDPGGFQKVKYVESVPVTCMTKNFTQWGCQPEGAYPDPDLEYRNISQDILEQVYKQEWPWNTYHWPLWQMENMRQWMKENEKEYTSRNNKTKEDIDALLAGKIRGRFCVPYPFALLKCEEWCWYPANINQETGHAQQIKINCTKAKAVSCTEQMPLAAVQRVYWEKEDEEGMKFMNIQACNESQLRCKTSPGGCVQGYPIPVGAEIIPESMKYLRGKKSPYGGIKDKNGELKLPLSVRVWVRMANLSGWVNGTPPYWSARIKGSTGINGTRWYGIGTLHHLGYNISSNPEKGLCNFTKELWIGGDRFQYQYKPSWNCSQNWTGYPVWHVFRYLDMTEHMTSRCVQRPLRHNITVGNGTITGNCSVTDWEGCNCTRSGNYLYNSTTGGLLVIICRQNSTITGIMGTNTNWTTMWGIYKNCSECKNSTLDRTDNGTLGTVNNINCSLPHYNESNKWTCAARNSKKKRDSLYIAGRDFWGRVKALYSCESNLGGLDGMMHQQMVLQKYQVIKVRAYTYGVVDMPKAYREKNMRNKRSTEISRPRKKRGIGLVIVLAIMAIIAAAGAGLGVANAVQQSYTRTAVQSLANATAAQQNVLEATYAMVQHVAKGVRILEARVARVEARVDRMMLYHELDCWHYQHYCVTSTRTEVAQYVNWTRYKDNCTWQQWEEEIEQHEANLSLLLKEAALQVQIAQRDAQRIPDVWKALQEAFDWSGWFSWLKYIPWIVVCIVGVICFRLLMCVITMCLQAYRQVREIRYTRVTVVIEAPVDLEEKQREERDGSSGSENLEHEKRTSPRSFIQIWRATVQAWKTSPWGKGWKKILYMTLLPLLTLQIWMEETGWNGDKRCKKKKERVDCQDRESMPAIENEYVELS

SEQ ID NO: 432 - protein, 9 aa, Artificial sequence
  Mutated sequence
  misc_feature (2)..(2): Xaa is Val or Met
  misc_feature (3)..(7): Xaa is any naturally occurring amino acid or is mutated
  misc_feature (9)..(9): Xaa is Met or Ile
RXXXXXXRX

SEQ ID NO: 433 - protein, 14 aa, Artificial sequence
  Mutated sequence
  MISC_FEATURE (4)..(4): Xaa is Val or Met
  MISC_FEATURE (5)..(9): Xaa is any naturally occurring amino acid or is mutated
  MISC_FEATURE (11)..(11): Xaa is Met or Ile
  MISC_FEATURE (13)..(13): Xaa is Leu or Ile or Val
VARXXXXXXRXMXY

SEQ ID NO: 434 - protein, 16 aa, Artificial sequence
  Mutated sequence
  MISC_FEATURE (1)..(1): Xaa is Thr or Val or Met
  MISC_FEATURE (2)..(2): Xaa is Leu or Ile
  MISC_FEATURE (3)..(3): Xaa is Ser or Thr or Asn or Gln or Glu  or Asp or Lys or Arg or His or Met or Cys or Trp or Phe or Tyr or Ala or Val or Leu or Ile or Pro or is deleted
  MISC_FEATURE (5)..(5): Xaa is Lys or Thr or Arg
  MISC_FEATURE (6)..(6): Xaa is Val or Ile
  MISC_FEATURE (7)..(7): Xaa is Glu or Arg
  MISC_FEATURE (9)..(9): Xaa is Ile or Met or Thr or Leu
  MISC_FEATURE (10)..(14): Xaa is any naturally occurring amino acid or is mutated
XXXLXXXAXXXXXXTA

SEQ ID NO: 435 - DNA, 33 bp, Artificial sequence
  oligonucleotide for introducing mutation within the ISU of lentiviral protein
ataggatccagaaccatggagacagacacactc

SEQ ID NO: 436 - DNA, 32 bp, Artificial sequence
  oligonucleotide for introducing mutation within the ISU of lentiviral protein
tatgcggccgcttaccttgtccacaactcaag

SEQ ID NO: 437 - DNA, 30 bp, Artificial sequence
  oligonucleotide for introducing mutation within the ISU of lentiviral protein
atagctgcagcccaagttctggcaacccat

SEQ ID NO: 438 - DNA, 30 bp, Artificial sequence
  oligonucleotide for introducing mutation within the ISU of lentiviral protein
tataagcttttaccttgtccacaactcaag

SEQ ID NO: 439 - DNA, 39 bp, Artificial sequence
  oligonucleotide for introducing mutation within the ISU of lentiviral protein
catcaagtactagtaatagcattaaaagtagaagctatg

SEQ ID NO: 440 - DNA, 39 bp, Artificial sequence
  oligonucleotide for introducing mutation within the ISU of lentiviral protein
catagcttctacttttaatgctattactagtacttgatg

SEQ ID NO: 441 - DNA, 40 bp, Artificial sequence
  oligonucleotide for introducing mutation within the ISU of lentiviral protein
gattaaaagtagaagctatgggaaaatttttgtatacagc

SEQ ID NO: 442 - DNA, 40 bp, Artificial sequence
  oligonucleotide for introducing mutation within the ISU of lentiviral protein
gctgtatacaaaaattttcccatagcttctacttttaatc

SEQ ID NO: 443 - DNA, 40 bp, Artificial sequence
  oligonucleotide for introducing mutation within the ISU of lentiviral protein
gattaaaagtagaagctatgttaaaatttttgtatacagc

SEQ ID NO: 444 - DNA, 40 bp, Artificial sequence
  oligonucleotide for introducing mutation within the ISU of lentiviral protein
gctgtatacaaaaattttaacatagcttctacttttaatc

SEQ ID NO: 445 - DNA, 36 bp, Artificial sequence
  oligonucleotide for introducing mutation within the ISU of lentiviral protein
gtagaagctatggaaggatttttgtatacagctttc

SEQ ID NO: 446 - DNA, 36 bp, Artificial sequence
  oligonucleotide for introducing mutation within the ISU of lentiviral protein
gaaagctgtatacaaaaatccttccatagcttctac

SEQ ID NO: 447 - DNA, 36 bp, Artificial sequence
  oligonucleotide for introducing mutation within the ISU of lentiviral protein
gtagaagctatggaattatttttgtatacagctttc

SEQ ID NO: 448 - DNA, 36 bp, Artificial sequence
  oligonucleotide for introducing mutation within the ISU of lentiviral protein
gaaagctgtatacaaaaataattccatagcttctac

SEQ ID NO: 449 - DNA, 33 bp, Artificial sequence
  oligonucleotide for introducing mutation within the ISU of lentiviral protein
gaagctatggaaaaaggattgtatacagctttc

SEQ ID NO: 450 - DNA, 33 bp, Artificial sequence
  oligonucleotide for introducing mutation within the ISU of lentiviral protein
gaaagctgtatacaatcctttttccatagcttc

SEQ ID NO: 451 - DNA, 33 bp, Artificial sequence
  oligonucleotide for introducing mutation within the ISU of lentiviral protein
gaagctatggaaaaattattgtatacagctttc

SEQ ID NO: 452 - DNA, 33 bp, Artificial sequence
  oligonucleotide for introducing mutation within the ISU of lentiviral protein
gaaagctgtatacaataatttttccatagcttc

SEQ ID NO: 453 - DNA, 36 bp, Artificial sequence
  oligonucleotide for introducing mutation within the ISU of lentiviral protein
gctatggaaaaatttggatatacagctttcgctatg

SEQ ID NO: 454 - DNA, 36 bp, Artificial sequence
  oligonucleotide for introducing mutation within the ISU of lentiviral protein
catagcgaaagctgtatatccaaatttttccatagc

SEQ ID NO: 455 - DNA, 36 bp, Artificial sequence
  oligonucleotide for introducing mutation within the ISU of lentiviral protein
ctatggaaaaatttttgggaacagctttcgctatgc

SEQ ID NO: 456 - DNA, 36 bp, Artificial sequence
  oligonucleotide for introducing mutation within the ISU of lentiviral protein
gcatagcgaaagctgttcccaaaaatttttccatag

SEQ ID NO: 457 - DNA, 36 bp, Artificial sequence
  oligonucleotide for introducing mutation within the ISU of lentiviral protein
ctatggaaaaatttttgttaacagctttcgctatgc

SEQ ID NO: 458 - DNA, 36 bp, Artificial sequence
  oligonucleotide for introducing mutation within the ISU of lentiviral protein
gcatagcgaaagctgttaacaaaaatttttccatag

SEQ ID NO: 459 - DNA, 40 bp, Artificial sequence
  oligonucleotide for introducing mutation within the ISU of lentiviral protein
gattaaaagtagaagctatgtttaaatttttgtatacagc

SEQ ID NO: 460 - DNA, 40 bp, Artificial sequence
  oligonucleotide for introducing mutation within the ISU of lentiviral protein
gctgtatacaaaaatttaaacatagcttctacttttaatc

SEQ ID NO: 461 - DNA, 36 bp, Artificial sequence
  oligonucleotide for introducing mutation within the ISU of lentiviral protein
gtagaagctatggaattttttttgtatacagctttc

SEQ ID NO: 462 - DNA, 36 bp, Artificial sequence
  oligonucleotide for introducing mutation within the ISU of lentiviral protein
gaaagctgtatacaaaaaaaattccatagcttctac

SEQ ID NO: 463 - DNA, 36 bp, Artificial sequence
  oligonucleotide for introducing mutation within the ISU of lentiviral protein
gctatggaaaaatttttttatacagctttcgctatg

SEQ ID NO: 464 - DNA, 36 bp, Artificial sequence
  oligonucleotide for introducing mutation within the ISU of lentiviral protein
catagcgaaagctgtataaaaaaatttttccatagc

SEQ ID NO: 465 - DNA, 36 bp, Artificial sequence
  oligonucleotide for introducing mutation within the ISU of lentiviral protein
ctatggaaaaatttttgtttacagctttcgctatgc

SEQ ID NO: 466 - DNA, 36 bp, Artificial sequence
  oligonucleotide for introducing mutation within the ISU of lentiviral protein
gcatagcgaaagctgtaaacaaaaatttttccatag

SEQ ID NO: 467 - protein, 16 aa, Artificial sequence
  Mutated sequence
  MISC_FEATURE (1)..(5): Xaa is any naturally occurring amino acid or is mutated
  MISC_FEATURE (6)..(6): Xaa is Val or Ile
  MISC_FEATURE (7)..(7): Xaa is Glu or Arg
  MISC_FEATURE (9)..(9): Xaa is Ile or Met or Thr or Leu
  MISC_FEATURE (12)..(12): Xaa is Phe or Pro
  MISC_FEATURE (13)..(13): Xaa is Leu or Val or Ile
XXXXXXXAXEKXXYTA

SEQ ID NO: 468 - protein, 16 aa, Artificial sequence
  Mutated sequence
  MISC_FEATURE (1)..(1): Xaa is Thr or Val or Met
  MISC_FEATURE (2)..(2): Xaa is Leu or Ile
  MISC_FEATURE (3)..(3): Xaa is Ser or Thr or Asn or Gln or Glu or Asp or Lys or Arg or His or Met or Cys or Trp or Phe or Tyr or Ala or Val or Leu or Ile or Pro or is deleted
  MISC_FEATURE (5)..(5): Xaa is Lys or Thr or Arg
  MISC_FEATURE (6)..(6): Xaa is Val or Ile
  MISC_FEATURE (7)..(7): Xaa is Glu or Arg
  MISC_FEATURE (9)..(9): Xaa is Ile or Met or Thr or Leu
  MISC_FEATURE (12)..(12): Xaa is Phe or Pro
  MISC_FEATURE (13)..(13): Xaa is Leu or Val or Ile
XXXLXXXAXEKXXYTA

SEQ ID NO: 469 - protein, 72 aa, FIV
QVLATHQEAIEKVTEALKINNLRLVTLEHQVLVIGLKVEAMEKFLYTAFAMQELGCNQNQFFCKVPPVLWER

SEQ ID NO: 470 - protein, 72 aa, FIV
QVLATHQEAVEKVTEALKINNLRLVTLEHQVLVIGLKVEAMEKFLYTAFAMQELGCNQNQFFCKIPPELWTR

SEQ ID NO: 471 - protein, 72 aa, FIV
QVLATHQEAIEKVTEALKINNLRLVTLEHQVLVIGLKVEAMEKFLYTAFAMQELGCNQNQFFCKIPPGLWTR

SEQ ID NO: 472 - protein, 72 aa, FIV
QVLATHQEAIEKVTGALKINNLRLVTLEHQVLVIGLKVEAMEKFLYTAFAMQELGCNQNQFFCKIPLELWTR

SEQ ID NO: 473 - protein, 72 aa, FIV
QVLATQQEAIEKVTEALKITNLRLVTLEHQVLVIGLKVEAMEKFLYTAFAMQELGCNQNQFFCKVPPELWRR

SEQ ID NO: 474 - protein, 72 aa, FIV
QVLATHQEALDKITEALKINNLRLVTLEHQVLVIGLKVEATEKFLYTAFAMQELGCNQNQFFCKIPCELWMR

SEQ ID NO: 475 - protein, 72 aa, FIV
QVLATHQQALDKITEALKINNLRLITLEHQVLVIGLKVEAIEKFLYTAFAMQELGCNQNQFFCKIPPSLWSM

SEQ ID NO: 476 - protein, 72 aa, FIV
QVLATHQQALEKITEALKINNLRLITLEHQVLVIGLRVEAIEKFLYTAFAMQELGCNQNQFFCKIPPSLWSM

SEQ ID NO: 477 - protein, 72 aa, FIV
QVLATHQQALEKITEALKINNLRLITLEHQVLVIGLKVEAIEKFLYTAFAMQELGCHQNQFFCKIPPSLWSM

SEQ ID NO: 478 - protein, 72 aa, FIV
QVLATHQHALDKITEALKINNLRLITLVHQVLVIGLKVRAIEKPLYTAFAMQELGCNQNQFFCKIPPSLWSM

SEQ ID NO: 479 - protein, 72 aa, FIV
QVLATHQQALDKITQALKINNLRLITLEHQVLVIGLKVEAIEKFLYTAFAMQELGCNQNQFFCKIPPSLWSM

SEQ ID NO: 480 - protein, 72 aa, FIV
QVLATHQQALDKITEALKINNLRLITLEHQVLVIGLKVEAIEKFLYTAFAMQELGCNQNQFFCKIPLNLWNM

SEQ ID NO: 481 - protein, 72 aa, FIV
QVLATHQQALEKITEALKINNLRLVTLEHQVLMIGLKVEAIEKFLYTAFAMQELGCNQNQFFCKIPLNLWTM

SEQ ID NO: 482 - protein, 72 aa, FIV
QVLATHQKAIDQITEALKINNLRLVTLEHQVLVIGLKVEAIEKFIYTAFAMQELGCNQNQFFCKIPPELWIR

SEQ ID NO: 483 - protein, 72 aa, FIV
QVLATHQEALDKITEALKINNLRLVTLEHQMLVIGLKVEAIEKFLYTAFAMQELGCNQNQFFCEIPKELWLR

SEQ ID NO: 484 - protein, 72 aa, FIV
QVLATHQEAIEKVTEALKINNLRLVTLEHQVLVIGLKVEAMEKFLYTAFAMQELGCNQNQFFCKVPSALWER

SEQ ID NO: 485 - protein, 72 aa, FIV
QVLATHQEAIEKVTEALKINNLRLVTLEHQVLVIGLKVEAMEKFLYTAFAMQELGCNQNQFFCKVPPQLWKR

SEQ ID NO: 486 - protein, 72 aa, FIV
QVLATHQETIEKVTEALKINNLRLVTLEHQVLVIGLKVEAMEKFLYTAFAMQELGCNQNQFFCKVPPELWKR

SEQ ID NO: 487 - protein, 72 aa, FIV
QVLATHQEAIEKVTEALKVNNLRLITLEHQVLVIGLKVEAMEKFLYTAFAMQELGCNQNQFFCKVPPELWKR

SEQ ID NO: 488 - protein, 72 aa, FIV
QVLATHQETIEKITEALKVNNLRLVTLEHQVLVIGLKVEAIEKFLYTAFAMQELGCNQNQFFCKVPPELWQR

SEQ ID NO: 489 - protein, 9 aa, Artificial sequence
  Mutated sequence
  MISC_FEATURE (2)..(2): Xaa is Ile or Met or Thr or Leu
  MISC_FEATURE (3)..(3): Xaa is Ala or Gly or Arg
  MISC_FEATURE (5)..(5): Xaa is Phe or Pro
  MISC_FEATURE (6)..(6): Xaa is Leu or Val or Ile
AXXKXXYTA

SEQ ID NO: 490 - protein, 9 aa, Artificial sequence
  Mutated sequence
  MISC_FEATURE (2)..(2): Xaa is Ile or Met or Thr or Leu
  MISC_FEATURE (4)..(4): Xaa is Ala or Gly or Arg
  MISC_FEATURE (5)..(5): Xaa is Phe or Pro
  MISC_FEATURE (6)..(6): Xaa is Leu or Val or Ile
AXEXXXYTA

SEQ ID NO: 491 - protein, 9 aa, Artificial sequence
  Mutated sequence
  MISC_FEATURE (2)..(2): Xaa is Ile or Met or Thr or Leu
  MISC_FEATURE (5)..(5): Xaa is Ala or Gly or Arg
  MISC_FEATURE (6)..(6): Xaa is Leu or Val or Ile
AXEKXXYTA

SEQ ID NO: 492 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Ala or Gly or Arg
AXEKXXYTA

SEQ ID NO: 493 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
  MISC_FEATURE (7)..(7): Xaa is Ala or Gly or Arg
AXEKXXXTA

SEQ ID NO: 494 - protein, 9 aa, Artificial sequence
  Mutated sequence
  MISC_FEATURE (2)..(2): Xaa is Ile or Met or Thr or Leu
  MISC_FEATURE (5)..(5): Xaa is Ala or Gly or Arg
  MISC_FEATURE (6)..(6): Xaa is Ala or Gly or Arg
AXEKXXYTA

SEQ ID NO: 495 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
AXEGXXYTA

SEQ ID NO: 496 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
AXEKXXGTA

SEQ ID NO: 497 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
AXRKXXYTA

SEQ ID NO: 498 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
AXERXXYTA

SEQ ID NO: 499 - protein, 9 aa, Artificial sequence
  Mutated sequence
  misc_feature (2)..(2): Xaa is Ile or Met or Thr or Leu
  misc_feature (6)..(6): Xaa is Leu or Val or Ile
AXEKRXYTA

SEQ ID NO: 500 - protein, 9 aa, Artificial sequence
  Mutated sequence
  misc_feature (2)..(2): Xaa is Ile or Met or Thr or Leu
  misc_feature (5)..(5): Xaa is Phe or Pro
AXEKXRYTA

SEQ ID NO: 501 - protein, 9 aa, Artificial sequence
  Mutated sequence
  MISC_FEATURE (2)..(2): Xaa is Ile or Met or Thr or Leu
  MISC_FEATURE (5)..(5): Xaa is Phe or Pro
  MISC_FEATURE (6)..(6): Xaa is Leu or Val or Ile
AXEKXXRTA

SEQ ID NO: 502 - protein, 9 aa, Artificial sequence
  Mutated sequence
  MISC_FEATURE (2)..(2): Xaa is Ile or Met or Thr or Leu
AXEKRRYTA

The invention claimed is:

1. A pharmaceutical composition comprising as an active substance an isolated mutated feline lentiviral ENV protein that has lost at least 50%, at least 75% or 100% of its immunosuppressive activity in comparison to immunosuppressive activity of a wild type ENV protein, or a fragment thereof, said fragment of said isolated mutated feline lentiviral ENV protein comprising at least 40 amino acids, said mutated feline lentiviral ENV protein resulting from mutation of the transmembrane (TM) subunit of a wild type feline lentiviral ENV protein, said mutated ENV protein having at least 80% identity to the sequence SEQ ID NO: 5, said mutated feline lentiviral ENV protein or fragment thereof comprising a mutated immunosuppressive domain (ISU) containing the following amino acid sequence:

```
                              (SEQ ID NO: 1)
A-[I/M/T/L]-X1-X2-X3-X4-X5-T-A,
``` wherein, $X_1$ is A or R, and $X_2$, $X_3$, $X_4$ and $X_5$ are any amino acid, or $X_2$ is A or R, and $X_1$, $X_3$, $X_4$ and $X_5$ are any amino acid, or $X_3$ is A or R, and $X_1$, $X_2$, $X_4$ and $X_5$ are any amino acid, or $X_4$ is A or R, and $X_1$, $X_2$, $X_3$ and $X_5$ are any amino acid, or $X_5$ is A or R, and $X_1$, $X_2$, $X_3$ and $X_4$ are any amino acid, in association with a pharmaceutically acceptable carrier.

2. A pharmaceutical composition comprising as an active substance an isolated mutated feline lentiviral ENV protein that has lost at least 50%, at least 75% or 100% of its immunosuppressive activity in comparison to immunosuppressive activity of a wild type ENV protein, or a fragment thereof, said fragment of said isolated mutated feline lentiviral ENV protein comprising at least 40 amino acids, said mutated feline lentiviral ENV protein resulting from mutation of the transmembrane (TM) subunit of a wild type feline lentiviral ENV protein, said mutated ENV protein having at least 80% identity to the sequence SEQ ID NO: 5, said mutated feline lentiviral ENV protein or fragment thereof comprising a mutated immunosuppressive domain (ISU) containing the following amino acid sequence:

```
                              (SEQ ID NO: 3)
[V/I]-[E/R]-A-[I/M/T/L]-X1-X2-X3-X4-X5-T-A-[F/L]-
A-M,
``` wherein, $X_1$ is A or R, and $X_2$, $X_3$, $X_4$ and $X_5$ are any amino acid, or $X_2$ is A or R, and $X_1$, $X_3$, $X_4$ and $X_5$ are any amino acid, or $X_3$ is A or R, and $X_1$, $X_2$, $X_4$ and $X_5$ are any amino acid, or $X_4$ is A or R, and $X_1$, $X_2$, $X_3$ and $X_5$ are any amino acid, or $X_5$ is A or R, and $X_1$, $X_2$, $X_3$ and $X_4$ are any amino acid, in association with a pharmaceutically acceptable carrier.

3. The pharmaceutical composition according to claim 1, wherein said loss of at least 50%, at least 75% or 100% of the immunosuppressive activity of said mutated feline lentiviral ENV protein or of said fragment thereof being liable to be assessed by the fact that in an in vivo assay involving engrafted tumor cells rejection, in animals excluding human beings, said tumor cells being transduced either so as to express said mutated ENV protein or said fragment (mutated ENV tumor cells), or said tumor cells being transduced so as to express said wild type ENV protein or a fragment thereof (wild type ENV tumor cells), or said tumor cells being not transduced (normal tumor cells), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

4. The pharmaceutical composition according to claim 1, wherein:

$X_1$ is A or R, $X_2$ is A or R, and $X_3$, $X_4$ and $X_5$ are any amino acid, or $X_1$ is A or R, $X_3$ is A or R, and $X_2$, $X_4$ and $X_5$ are any amino acid, or $X_1$ is A or R, $X_4$ is A or R, and $X_2$, $X_3$ and $X_5$ are any amino acid, or $X_1$ is A or R, $X_5$ is A or R, and $X_2$, $X_3$ and $X_4$ are any amino acid, or $X_2$ is A or R, $X_3$ is A or R, and $X_1$, $X_4$ and $X_5$ are any amino acid, or $X_2$ is A or R, $X_4$ is A or R, and $X_1$, $X_3$ and $X_5$ are any amino acid, or $X_2$ is A or R, $X_5$ is A or R, and $X_1$, $X_3$ and $X_4$ are any amino acid, or $X_3$ is A or R, $X_4$ is A or R, and $X_1$, $X_2$ and $X_5$ are any amino acid, or $X_3$ is A or R, $X_5$ is A or R, and $X_1$, $X_2$ and $X_4$ are any amino acid, or $X_4$ is A or R, $X_5$ is A or R, and $X_1$, $X_2$ and $X_3$ are any amino acid.

5. The pharmaceutical composition according to claim 1, wherein:

$X_1$ is R, and $X_2$, $X_3$, $X_4$ and $X_5$ are any amino acid, or $X_2$ is R, and $X_1$, $X_3$, $X_4$ and $X_5$ are any amino acid, or $X_3$ is R, and $X_1$, $X_2$, $X_4$ and $X_5$ are any amino acid, or $X_4$ is R, and $X_1$, $X_2$, $X_3$ and $X_5$ are any amino acid, or $X_5$ is R, and $X_1$, $X_2$, $X_3$ and $X_4$ are any amino acid.

6. The pharmaceutical composition according to claim 1, wherein:

$X_1$ is R, $X_2$ is R, and $X_3$, $X_4$ and $X_5$ are any amino acid, or $X_1$ is R, $X_3$ is R, and $X_2$, $X_4$ and $X_5$ are any amino acid, or $X_1$ is R, $X_4$ is R, and $X_2$, $X_3$ and $X_5$ are any amino acid, or $X_1$ is R, $X_5$ is R, and $X_2$, $X_3$ and $X_4$ are any amino acid, or $X_2$ is R, $X_3$ is R, and $X_1$, $X_4$ and $X_5$ are any amino acid, or $X_2$ is R, $X_4$ is R, and $X_1$, $X_3$ and $X_5$ are any amino acid, or $X_2$ is R, $X_5$ is R, and $X_1$, $X_3$ and $X_4$ are any amino acid, or $X_3$ is R, $X_4$ is R, and $X_1$, $X_2$ and $X_5$ are any amino acid, or $X_3$ is R, $X_5$ is R, and $X_1$, $X_2$ and $X_4$ are any amino acid, or $X_4$ is R, $X_5$ is R, and $X_1$, $X_2$ and $X_3$ are any amino acid.

7. The pharmaceutical composition according to claim 1, wherein:

$X_1$ is A or R, and $X_2$, $X_3$, $X_4$ and $X_5$ are any amino acid different from A, G or R, or $X_2$ is A or R, and $X_1$, $X_3$, $X_4$ and $X_5$ are any amino acid different from A, G or R, or $X_3$ is A or R, and $X_1$, $X_2$, $X_4$ and $X_5$ are any amino acid different from A, G or R, or $X_4$ is A or R, and $X_1$, $X_2$, $X_3$ and $X_5$ are any amino acid different from A or R, or $X_5$ is A or R, and $X_1$, $X_2$, $X_3$ and $X_4$ are any amino acid different from A, G or R.

8. The pharmaceutical composition according to claim 1, wherein:

$X_1$ is A or R, $X_2$ is A, G or R, and $X_3$, $X_4$ and $X_5$ are any amino acid different from A, G or R, or $X_1$ is A or R, $X_3$ is A, G or R, and $X_2$, $X_4$ and $X_5$ are any amino acid different from A, G or R, or $X_1$ is A or R, $X_4$ is A, G or R, and $X_2$, $X_3$ and $X_5$ are any amino acid different from A, G or R, or $X_1$ is A or R, $X_5$ is A, G or R, and $X_2$, $X_3$ and $X_4$ are any amino acid different from A, G or R, or $X_2$ is A or R, $X_3$ is A, G or R, and $X_1$, $X_4$ and $X_5$ are any amino acid different from A, G or R, or $X_2$ is A or R, $X_4$ is A, G or R, and $X_1$, $X_3$ and $X_5$ are any amino acid different from A, G or R, or $X_2$ is A or R, $X_5$ is A, G or R, and $X_1$, $X_3$ and $X_4$ are any amino acid different from A, G or R, or $X_3$ is A or R, $X_4$ is A, G or R, and $X_1$, $X_2$ and $X_5$ are any amino acid different from A, G or R, or $X_3$ is A or R, $X_5$ is A, G or R, and $X_1$, $X_2$ and $X_4$ are any amino acid different from A, G or R, or $X_4$ is A or R, $X_5$ is A, G or R, and $X_1$, $X_2$ and $X_3$ are any amino acid different from A, G or R.

9. The pharmaceutical composition according to claim 1, wherein:

```
                                       (SEQ ID NO: 489)
A-[I/M/T/L]-[A/G/R]-K-[F/P]-[L/V/I]-Y-T-A,
or
                                       (SEQ ID NO: 490)
A-[I/M/T/L]-E-[A/G/R]-[F/P]-[L/V/I]-Y-T-A,
or
                                       (SEQ ID NO: 491)
A-[I/M/T/L]-E-K-[A/G/R]-[L/V/I]-Y-T-A,
or
                                       (SEQ ID NO: 492)
A-[I/M/T/L]-E-K-[F/P]-[A/G/R]-Y-T-A,
or
                                       (SEQ ID NO: 493)
A-[I/M/T/L]-E-K-[F/P]-[L/V/I]-[A/G/R]-T-A,
or
                                       (SEQ ID NO: 494)
A-[I/M/T/L]-E-K-[A/G/R]-[A/G/R]-Y-T-A,
in particular:
                                       (SEQ ID NO: 489)
A-[I/M/T/L]-[A/G/R]-K-[F/P]-[L/V/I]-Y-T-A,
or
                                       (SEQ ID NO: 495)
A-[I/M/T/L]-E-G-[F/P]-[L/V/I]-Y-T-A,
or
                                       (SEQ ID NO: 491)
A-[I/M/T/L]-E-K-[A/G/R]-[L/V/I]-Y-T-A,
or
                                       (SEQ ID NO: 492)
A-[I/M/T/L]-E-K-[F/P]-[A/G/R]-Y-T-A,
or
                                       (SEQ ID NO: 496)
A-[I/M/T/L]-E-K-[F/P]-[L/V/I]-G-T-A,
or
                                       (SEQ ID NO: 494)
A-[I/M/T/L]-E-K-[A/G/R]-[A/G/R]-Y-T-A.
```

10. The pharmaceutical composition according to claim 1, wherein:

```
                                       (SEQ ID NO: 497)
A-[I/M/T/L]-R-K-[F/P]-[L/V/I]-Y-T-A,
or
                                       (SEQ ID NO: 498)
A-[I/M/T/L]-E-R-[F/P]-[L/V/I]-Y-T-A,
or
                                       (SEQ ID NO: 499)
A-[I/M/T/L]-E-K-R-[L/V/I]-Y-T-A,
or
                                       (SEQ ID NO: 500)
A-[I/M/T/L]-E-K-[F/P]-R-Y-T-A,
or
                                       (SEQ ID NO: 501)
A-[I/M/T/L]-E-K-[F/P]-[L/V/I]-R-T-A,
or
                                       (SEQ ID NO: 502)
A-[I/M/T/L]-E-K-R-R-Y-T-A.
```

11. The pharmaceutical composition according to claim 1, wherein said isolated mutated feline lentiviral ENV protein or said fragment thereof, comprises one of the amino acid sequences SEQ ID NO: 28 to 171.

12. The pharmaceutical composition according to claim 1, wherein said isolated mutated feline lentiviral ENV protein consists of one of the amino acid sequences: SEQ ID NO: 5 and SEQ ID NO: 317 to 342 and 374 to 419.

13. The pharmaceutical composition as defined in claim 1, wherein the composition stimulates an immune response in a host organism.

14. The pharmaceutical composition according to claim 2, wherein
said loss of at least 50%, at least 75% or 100% of the immunosuppressive activity of said mutated feline lentiviral ENV protein or of said fragment thereof being liable to be assessed by the fact that in an in vivo assay involving engrafted tumor cells rejection, in animals excluding human beings,
said tumor cells being transduced either so as to express said mutated ENV protein or said fragment (mutated ENV tumor cells),
or said tumor cells being transduced so as to express said wild type ENV protein or a fragment thereof (wild type ENV tumor cells),
or said tumor cells being not transduced (normal tumor cells),
the following ratio:
immunosuppression index of said mutated ENV protein or of said fragment ($i_{mutated\ env}$)/immunosuppression index of wild type ENV protein ($i_{wild\ type\ env}$) is less than 0.5, or even less than 0.25,
$i_{mutated\ env}$ being defined by: (maximum area reached by mutated ENV tumor cells−maximum area reached by normal tumor cells)/(maximum area reached by normal tumor cells), and
$i_{wild\ type\ env}$ being defined by: (maximum area reached by wild type ENV tumor cells−maximum area reached by normal tumor cells)/(maximum area reached by normal tumor cells).

15. The pharmaceutical composition according to claim 2, wherein:
$X_1$ is A or R, $X_2$ is A or R, and $X_3$, $X_4$ and $X_5$ are any amino acid, or
$X_1$ is A or R, $X_3$ is A or R, and $X_2$, $X_4$ and $X_5$ are any amino acid, or
$X_1$ is A or R, $X_4$ is A or R, and $X_2$, $X_3$ and $X_5$ are any amino acid, or
$X_1$ is A or R, $X_5$ is A or R, and $X_2$, $X_3$ and $X_4$ are any amino acid, or
$X_2$ is A or R, $X_3$ is A or R, and $X_1$, $X_4$ and $X_5$ are any amino acid, or
$X_2$ is A or R, $X_4$ is A or R, and $X_1$, $X_3$ and $X_5$ are any amino acid, or
$X_2$ is A or R, $X_5$ is A or R, and $X_1$, $X_3$ and $X_4$ are any amino acid, or
$X_3$ is A or R, $X_4$ is A or R, and $X_1$, $X_2$ and $X_5$ are any amino acid, or
$X_3$ is A or R, $X_5$ is A or R, and $X_1$, $X_2$ and $X_4$ are any amino acid, or
$X_4$ is A or R, $X_5$ is A or R, and $X_1$, $X_2$ and $X_3$ are any amino acid.

16. The pharmaceutical composition according to claim 2, wherein:
$X_1$ is R, and $X_2$, $X_3$, $X_4$ and $X_5$ are any amino acid, or
$X_2$ is R, and $X_1$, $X_3$, $X_4$ and $X_5$ are any amino acid, or
$X_3$ is R, and $X_1$, $X_2$, $X_4$ and $X_5$ are any amino acid, or
$X_4$ is R, and $X_1$, $X_2$, $X_3$ and $X_5$ are any amino acid, or
$X_5$ is R, and $X_1$, $X_2$, $X_3$ and $X_4$ are any amino acid.

17. The pharmaceutical composition according to claim 1, wherein said mutated ENV protein has at least 90% identity to the sequence SEQ ID NO: 5.

18. The pharmaceutical composition according to claim 1, wherein said fragment of said isolated mutated feline lentiviral ENV protein comprises at least 60 amino acids.

19. The pharmaceutical composition according to claim 2, wherein said fragment of said isolated mutated feline lentiviral ENV protein comprises at least 60 amino acids.

20. The pharmaceutical composition according to claim 2, wherein said mutated ENV protein has at least 90% identity to the sequence SEQ ID NO: 5.

21. The pharmaceutical composition according to claim 7, wherein:
$X_1$ is R, and $X_2$, $X_3$, $X_4$ and $X_5$ are any amino acid different from A, G or R, or
$X_2$ is R, and $X_1$, $X_3$, $X_4$ and $X_5$ are any amino acid different from A, G or R, or
$X_3$ is R, and $X_1$, $X_2$, $X_4$ and $X_5$ are any amino acid different from A, G or R, or
$X_4$ is R, and $X_1$, $X_2$, $X_3$ and $X_5$ are any amino acid different from A, G or R, or
$X_5$ is R, and $X_1$, $X_2$, $X_3$ and $X_4$ are any amino acid different from A, G or R.

22. The pharmaceutical composition according to claim 8, wherein:
$X_1$ is R, $X_2$ is R, and $X_3$, $X_4$ and $X_5$ are any amino acid different from A, G or R, or
$X_1$ is R, $X_3$ is R, and $X_2$, $X_4$ and $X_5$ are any amino acid different from A, G or R, or
$X_1$ is R, $X_4$ is R, and $X_2$, $X_3$ and $X_5$ are any amino acid different from A, G or R, or
$X_1$ is R, $X_5$ is R, and $X_2$, $X_3$ and $X_4$ are any amino acid different from A, G or R, or
$X_2$ is R, $X_3$ is R, and $X_1$, $X_4$ and $X_5$ are any amino acid different from A, G or R, or
$X_2$ is R, $X_4$ is R, and $X_1$, $X_3$ and $X_5$ are any amino acid different from A, G or R, or
$X_2$ is R, $X_5$ is R, and $X_1$, $X_3$ and $X_4$ are any amino acid different from A, G or R, or
$X_3$ is R, $X_4$ is R, and $X_1$, $X_2$ and $X_5$ are any amino acid different from A, G or R, or
$X_3$ is R, $X_5$ is R, and $X_1$, $X_2$ and $X_4$ are any amino acid, different from A, G or R or
$X_4$ is R, $X_5$ is R, and $X_1$, $X_2$ and $X_3$ are any amino acid different from A, G or R.

23. A pharmaceutical composition comprising as active substance an isolated mutated feline lentiviral ENV protein that has lost at least 50%, at least 75%, or 100% of its immunosuppressive activity in comparison to immunosuppressive activity of a wild type ENV protein, or a fragment thereof comprising at least 40 amino acids,
said mutated feline lentiviral ENV protein resulting from mutation of the transmembrane (TM) subunit of a wild type feline lentiviral ENV protein,
said mutated ENV protein having 77% identity to sequence SEQ ID NO: 5,
said mutated feline lentiviral ENV protein or fragment thereof comprising a mutated immunosuppressive domain (ISU) containing the following amino acid sequence:

```
                         (SEQ ID NO: 1)
        A-[I/M/T/L]-X1-X2-X3-X4-X5-T-A,
```
wherein,
- $X_1$ is R, and $X_2$, $X_3$, $X_4$ and $X_5$ are any amino acid, or
- $X_2$ is R, and $X_1$, $X_3$, $X_4$ and $X_5$ are any amino acid, or
- $X_3$ is R, and $X_1$, $X_2$, $X_4$ and $X_5$ are any amino acid, or
- $X_4$ is R, and $X_1$, $X_2$, $X_3$ and $X_5$ are any amino acid, or
- $X_5$ is R, and $X_1$, $X_2$, $X_3$ and $X_4$ are any amino acid, in association with a pharmaceutically acceptable car